US012570998B2

(12) United States Patent
Zinn et al.

(10) Patent No.: US 12,570,998 B2
(45) Date of Patent: Mar. 10, 2026

(54) METHODS AND COMPOSITIONS FOR MODULATING THE INTERACTION BETWEEN ADENO-ASSOCIATED VIRUS (AAV) AND THE AAV RECEPTOR (AAVR) FOR ALTERED BIO-DISTRIBUTION OF AAV

(71) Applicants: MASSACHUSETTS EYE AND EAR INFIRMARY, Boston, MA (US); THE SCHEPENS EYE RESEARCH INSTITUTE, INC., Boston, MA (US)

(72) Inventors: Eric Zinn, Lynn, MA (US); Christopher Tipper, Cambridge, MA (US); Luk H. Vandenberghe, Weston, MA (US)

(73) Assignees: Massachusetts Eye & Ear Infirmary, Boston, MA (US); The Schepens Eye Research Institute, Inc., Boston, MA (US)

( * ) Notice: Subject to any disclaimer, the term of this patent is extended or adjusted under 35 U.S.C. 154(b) by 1023 days.

(21) Appl. No.: 17/641,535

(22) PCT Filed: Sep. 9, 2020

(86) PCT No.: PCT/US2020/050027
§ 371 (c)(1),
(2) Date: Mar. 9, 2022

(87) PCT Pub. No.: WO2021/050614
PCT Pub. Date: Mar. 18, 2021

(65) Prior Publication Data
US 2022/0411820 A1 Dec. 29, 2022

Related U.S. Application Data

(60) Provisional application No. 62/934,996, filed on Nov. 13, 2019, provisional application No. 62/897,973, filed on Sep. 9, 2019.

(51) Int. Cl.
| | |
|---|---|
| *C12N 15/86* | (2006.01) |
| *C07K 14/005* | (2006.01) |
| *C12N 7/00* | (2006.01) |

(52) U.S. Cl.
CPC ............ *C12N 15/86* (2013.01); *C07K 14/005* (2013.01); *C12N 7/00* (2013.01); *C12N 2750/14122* (2013.01); *C12N 2750/14143* (2013.01); *C12N 2750/14145* (2013.01)

(58) Field of Classification Search
CPC .......... C12N 15/86; C12N 2750/14143; A61K 35/76
See application file for complete search history.

(56) References Cited

U.S. PATENT DOCUMENTS

| | | | |
|---|---|---|---|
| 7,906,111 | B2 | 3/2011 | Wilson et al. |
| 9,695,220 | B2 | 7/2017 | Vandenberghe et al. |
| 9,719,070 | B2 | 8/2017 | Vandenberghe et al. |
| 10,077,291 | B2 | 9/2018 | Asokan et al. |
| 2011/0104119 | A1 | 5/2011 | Bowles et al. |
| 2014/0060163 | A1 | 3/2014 | Watanabe et al. |
| 2015/0152142 | A1 | 6/2015 | Asokan et al. |
| 2016/0044819 | A1 | 2/2016 | Bailey et al. |
| 2017/0067908 | A1 | 3/2017 | Nakai et al. |
| 2017/0159026 | A1 | 6/2017 | Kay et al. |
| 2017/0348433 | A1 | 12/2017 | Kay et al. |
| 2018/0032166 | A1 | 2/2018 | Orihara |
| 2019/0031851 | A1 | 1/2019 | Uchida |
| 2019/0047546 | A1 | 2/2019 | Asai et al. |
| 2019/0367562 | A1 | 12/2019 | Asokan et al. |

FOREIGN PATENT DOCUMENTS

| | | | | |
|---|---|---|---|---|
| CN | 103561774 | 2/2014 | | |
| CN | 105247044 | 1/2016 | | |
| CN | 106232618 | 12/2016 | | |
| JP | 2016-533709 | 11/2016 | | |
| WO | WO 2015/054653 | 4/2015 | | |
| WO | WO-2015164757 A1 * | 10/2015 | ............ | C12N 15/86 |
| WO | WO 2017/019994 | 2/2017 | | |
| WO | WO 2017/100791 | 6/2017 | | |
| WO | WO 2018/022608 | 2/2018 | | |
| WO | WO 2018/071831 | 4/2018 | | |
| WO | WO 2018/152333 | 8/2018 | | |
| WO | WO 2018/209154 | 11/2018 | | |
| WO | WO 2019/028306 A2 | 2/2019 | | |
| WO | WO 2019/104279 | 5/2019 | | |
| WO | WO 2019/217911 | 11/2019 | | |
| WO | WO 2020/041498 | 2/2020 | | |

(Continued)

OTHER PUBLICATIONS

Lochrie MA, Tatsuno GP, Christie B, McDonnell JW, Zhou S, Surosky R, Pierce GF, Colosi P. Mutations on the external surfaces of adeno-associated virus type 2 capsids that affect transduction and neutralization. J Virol. Jan. 2006;80(2):821-34. doi: 10.1128/JVI. 80.2.821-834.2006. (Year: 2006).*
Albright et al., "Mapping the Structural Determinants Required for AAVrh.10 Transport across the Blood-Brain Barrier," Molecular Therapy, 2018, 26(2), 21 pages.

(Continued)

*Primary Examiner* — Fereydoun G Sajjadi
*Assistant Examiner* — Qinhua Gu
(74) *Attorney, Agent, or Firm* — Fish & Richardson P.C.

(57) ABSTRACT

This disclosure describes compositions and methods for altering the bio-distribution of adeno-associated viruses (AAVs) in subjects.

21 Claims, 44 Drawing Sheets

Specification includes a Sequence Listing.

(56)　　　　　References Cited

FOREIGN PATENT DOCUMENTS

WO　　WO 2021/050614　　3/2021
WO　　WO 2022/150634　　7/2022

OTHER PUBLICATIONS

Altschul et al., "Gapped BLAST and PSI-BLAST: A new generation of protein database search programs," Nucleic Acids Res., 1997, 25(17):3389-3402.
Bowles et al., "Marker Rescue of Adeno-Associated Virus (AAV) Capsid Mutants: a Novel Approach for Chimeric AAV Production," J. Virol., 2003, 77:423-432.
Dayhoff et al., "22: A model of evolutionary change in proteins," Atlas of protein sequence and structure, vol. 5, National Biomedical Research Foundation Silver Spring, 1978, pp. 345-352.
Dudek et al., "An Alternate Route for Adeno-associated Virus (AAV) Entry Independent of AAV Receptor," J. Virol., Mar. 2018, 92(7):e02213-17, 15 pages.
Edgar, "MUSCLE: multiple sequence alignment with high accuracy and high throughput," Nucleic Acids Res., Mar. 2004, 32(5):1792-1797.
Extended European Search Report in European Appln. No. 19799988.1, dated Oct. 28, 2021, 7 pages.
Grimm et al., "In vitro and in vivo gene therapy vector evolution via multispecies interbreeding and retargeting of adeno-associated viruses," J. Virol., 2008, 82(12):5887-911.
International Preliminary Report on Patentability in International Application No. PCT/US2019/031851, dated Nov. 26, 2020, 6 pages.
International Preliminary Report on Patentability in International Application No. PCT/US2020/050027, dated Mar. 9, 2022, 10 pages.
International Search Report and Written Opinion in International Appln. No. PCT/US2019/031851, dated Aug. 29, 2019, 8 pages.
International Search Report and Written Opinion in International Appln. No. PCT/US2020/050027, dated Apr. 13, 2021, 18 pages.
Invitation to Pay Additional Fees And, Where Applicable, Protest Fee in International Appln. No. PCT/US2020/050027, dated Feb. 22, 2021, 11 pages.
Ling et al., "Human Hepatocyte Growth Factor Receptor Is a Cellular Coreceptor for Adeno-Associated Virus Serotype 3," Hum. Gene. Ther., 2010, 21(12)1741-1747.
Lisowski et al., "Selection and evaluation of clinically relevant AAV variants in a xenograft liver model," Nature, 2014, 506:382-386.
Meyer et al., "Structure of the gene therapy vector, adeno-associated virus with its cell receptor, AAVR," ELife, May 2019, 8:e44707, 24 pages.
Nam et al., "Structure of adeno-associated virus serotype 8, a gene therapy vector," J. Virol., 2007, 81(22):12260-71.
Office Action in Saudi Arabian Appln. No. 520420518, dated Mar. 15, 2022, 14 pages (with English machine translation).
Pillay et al., "An essential receptor for adeno-associated virus infection," Nature, Feb. 2016, 530(7588):108-12, 16 pages.
Raupp et al., "The Threefold Protrusions of Adeno-Associated Virus Type 8 Are Involved in Cell Surface Targeting as Well as Postat-tachment Processing," J. Virol., 2012, 86(17):9396-408.
Wu et al., "Single amino acid changes can influence titer, heparin binding, and tissue tropism in different adeno-associated virus serotypes," J. Virol., 2006, 80(22):11393-7.
Zhang et al., "Adeno-associated virus 2 bound to its cellular receptor AAVR," Nat. Microbiol., Apr. 2019, 4(4):675-682, 10 pages.
Zinn et al., "In Silico Reconstruction of the Viral Evolutionary Lineage Yields a Potent Gene Therapy Vector," Cell Rep., Aug. 2015, 12(6):1056-1068.

Office Action in Japanese Appln. No. 2020-563602, dated Aug. 29, 2023, 8 pages (with English translation).
Office Action in Japanese Appln. No. 2020-563602, dated Feb. 14, 2023, 11 pages (with English translation).
Office Action in Japanese Appln. No. 2022-515606, mailed on Sep. 10, 2024, 25 pages (with English translation).
Flytzanis et al., "Abstract 102: Engineered AAVS for CNS Transduc-tion and Peripheral Organ De-Targeting across Species after Sys-temic Delivery," Molecular Therapy, Apr. 2019, 27(4S1):54.
Kumar et al., "Abstract 99: Multiplexed-CREATE Selection Yields AAV Vectors Targeting Different Cell Types of the Central Nervous System Following Systemic Delivery," Molecular Therapy, Apr. 2019, 27(4S1):53.
Office Action in Chinese Appln. No. 201980042499.3, mailed on Nov. 14, 2024, 24 pages (with English translation).
Office Action in European Appln. No. 20789739.8, mailed on Nov. 19, 2024, 4 pages.
Office Action in Saudi Arabian Appln. No. 520420518, dated Dec. 13, 2022, 13 pages (with English machine translation).
Office Action in Australian Appln. No. 2019264991, mailed on Feb. 6, 2025, 4 pages.
Office Action in Korean Appln. No. 10-2020-7035395, mailed on Jan. 21, 2025, 10 pages (with English translation).
International Preliminary Report on Patentability in International Appln. No. PCT/US2022/011682, mailed Jul. 20, 2023, 14 pages.
Notice of Allowance in Japanese Appln. No. 2020-563602, dated Jan. 16, 2024, 5 pages (with English translation).
Genbank Accession No. QDH44216.1, "major coat protein VP1 [Adeno-associated virus]," Jul. 7, 2019, 2 pages.
Office Action in Canadian Appln. No. 3, 153,972, mailed on Jan. 7, 2025, 7 pages.
Office Action in Chinese Appln. No. 2020800779688, mailed on Dec. 31, 2024, 21 pages (with English translation).
Zincarelli et al., "Analysis of AAV serotypes 1-9 mediated gene expression and tropism in mice after systemic injection," Mol. Ther., Jun. 2008, 16(6):1073-1080.
Office Action in Canadian Appln. No. 3,100,006, dated Oct. 11, 2023, 3 pages.
Office Action in Canadian Appln. No. 3153972, dated Oct. 26, 2023, 5 pages.
Office Action in Chinese Appln. No. 201980042499.3, dated Oct. 19, 2023, 34 pages (with English translation).
Advances in Molecular Biophotonics, Shanghai Jio Tong University Press, Luo Qingming (ed)., Oct. 31, 2014, p. 191, 5 pages (with English translation).
Office Action in Chinese Appln. No. 201980042499.3, dated Jun. 28, 2024, 30 pages (with English translation).
Office Action in Israeli Appln. No. 278598, dated Jul. 9, 2024, 4 pages.
Bowles et al., "Phase 1 Gene Therapy for Duchenne Muscular Dystrophy Using a Translational Optimized AAV Vector," Molecu-lar Therapy, Feb. 2012, 20(2):443-455.
Drouin et al., "Adeno-associated virus structural biology as a tool in vector development," Future Virology, Dec. 2013, 8(12):1183-1199.
Invitation to Pay Additional Fees And, Where Applicable, Protest Fee in International Appln. No. PCT/US2022/011682, dated May 13, 2022, 19 pages.
Lochrie et al., "Mutations on the external surfaces of adeno-associated virus type 2 capsids that affect transduction and neutral-ization," Journal of Virology, Jan. 2006, 80(2):821-834.
International Search Report and Written Opinion in International Appln. No. PCT/US2022/011682, dated Jul. 4, 2022, 24 pages.
Office Action in Japanese Appln. No. 2024-020029, mailed on Feb. 25, 2025, 9 pages (with English translation).

* cited by examiner

FIG. 2

| %■ top 256 | 45.7 | 57.0 | 52.7 | 46.1 | 57.4 | 43.4 | 44.5 | 46.5 | 34.8 |
|---|---|---|---|---|---|---|---|---|---|
| %■ bottom 256 | 54.3 | 43.0 | 47.3 | 53.9 | 42.6 | 56.6 | 55.5 | 53.5 | 65.2 |

V708

AAV2

| % ■ top 512 | 45.9 | 51.8 | 51.6 | 54.1 | 23.6 | 47.5 | 43.8 | 44.1 | 56.8 | 57.8 |
|---|---|---|---|---|---|---|---|---|---|---|
| % ■ bottom 512 | 54.1 | 48.2 | 48.4 | 45.9 | 76.4 | 52.5 | 56.3 | 55.9 | 43.2 | 42.2 |

R446
AAV2

| %■ top 256 | 45.7 | 57.0 | 52.7 | 46.1 | 57.4 | 43.4 | 44.5 | 46.5 | 34.8 |
|---|---|---|---|---|---|---|---|---|---|
| %■ bottom 256 | 54.3 | 43.0 | 47.3 | 53.9 | 42.6 | 56.6 | 55.5 | 53.5 | 65.2 |

R741
AAV2

| %■ top 512 | 45.9 | 51.8 | 51.6 | 54.1 | 23.6 | 47.5 | 43.8 | 44.1 | 56.8 | 57.8 |
|---|---|---|---|---|---|---|---|---|---|---|
| %■ bottom 512 | 54.1 | 48.2 | 48.4 | 45.9 | 76.4 | 52.5 | 56.3 | 55.9 | 43.2 | 42.2 |

R471
AAV2

NHP2 Liver 8.2kg
Anc80 Library

266

Glysine 266

Alanine 266

NHP1 Liver 10.2kg
Anc80 Library

266

Glysine 266

Alanine 266

FIG. 7-1

```
AAV2  (AAC03780)    ATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKEN   90
AAV1  (AAD27757)    ..G..HAM.A...................................N....................PAE...T...........................   91
AAV6  (AAB95450)    ..G..HVM.A...............................................................PAE...T....................   91
AAV3  (AAC55049)    T.GT..H..A...................................M...........P.....P....................................   91
AAV LK03            T.RT..D..A...................................M...........P.....P....................................   91
AAV7  (AF513851_2)  Q.QV..N..A..........................N....................P....PEV.TP................................   92
AAV8  (AF513852_2)  QIGT..S..A..........................N....................D.P...MQS.LN...............................   93
AAV hu.37 (AAS99285) IVGN..S..A.........................N....................D.P....Q..L.................................   93
AAV rh.10 (AAO88201) IVGA..S..A.........................N....................D.P.A.NKD.LN................................   93
AAV9  (AAS99264)    Q.GW.QN..I..................................M....................D.P.A.NKD.LN......................   91
AAV hu.68           Q.GW.QN..I..................................M....................D.P....Q..L......................   91
AAV10 (AAT46337)    IVGN..S..A.........................N....................D.P....Q..L.................................   93
AAV5  (AAD13756)    ..GTY.L.EIV..S..ME......A....E.GA......MM......A......G.-I.S..DVPVS.......T..M....K...              79

AAV2  (AAC03780)    SKRWNPEIQYTSNYNKSVNVDFTVDTNGVYSEPRPIGTRYLTRNL-- 735
AAV1  (AAD27757)    .........V....A..A.............N..L.T.......P.- 736
AAV6  (AAB95450)    .........V....A..A.............N..L.T.......P.- 736
AAV3  (AAC55049)    ..............................................- 736
AAV LK03            ..........................................P.* 737
AAV7  (AF513851_2)  ............FE..TS...A..SQ.......A.N.E.-........- 737
AAV8  (AF513852_2)  ............Y..TS...A.N.E.T.....................- 738
AAV hu.37 (AAS99285) ...........Y..T....A.N.D.T.....................- 738
AAV rh.10 (AAO88201) ...........Y..T....A.N.E.......................- 738
AAV9  (AAS99264)    ...........Y..N....E.A.N.E.....................- 736
AAV hu.68           ...........Y..N....E.A.N.E.....................* 737
AAV10 (AAT46337)    ...........Y..T....A.N.E.T.....................- 738
AAV5  (AAD13756)    ..N...UFQF..AP-ST.E.RTT........................P.- 724
```

| | | |
|---|---|---|
| hu.40-E | 687 | WELQKENSKRWNPEIQYTSNYYKSTNVDFAVNTEGTYSEPRPIGTRYLTRNL* |
| AAV0-E | 687 | WELQKENSKRWNPEIQYTSNYYKSTNVDFAVNTEGTYSEPRPIGTRYLTRNL* |
| ch.50-E | 687 | WELQKENSKCWNPEIQYTSNYYKSTNVDFAVNTEGVYSEPRPIGTRYLTRNL* |
| ch.40-E | 687 | WELQKENSKRWNPEIQYTSNYYKSTNVDFAVNSEGTYSEPPIGTRYLTRNL* |
| hu.67-E | 687 | WELQKENSKRWNPEIQYTSNYYKSTNVDFAVNTEGTYSEPRPIGTRYLTRNL* |
| hu.17-E | 687 | WELQKENSKRWNPEIQYTSNYYKSVNVDFTVDTNGVYSEPRPIGTRYLTRNL* |
| hu.6-E | 687 | WELQKENSKRWNPEIQYTSNYYKSTNVDFAVNTEGTYSEPRPIGTRYLTRNL* |
| hu.66-E | 687 | WELQKENSKRWNPEIQYTSNYYKSTNVDFAVNTEGTYSEPRPIGTRYLTRNL* |
| ch.38-E | 687 | WELQKENSKRWNPEIQYTSNYYKSTNVDFAVNTEGVYSEPRPIGTRYLTRNL* |
| hu.32-F | 685 | WELQKENSKRWNPEIQYTSNYYKSNVEFAVNTEGVYSEPRPIGTRYLTRNL* |
| AAV9/hu | 685 | WELQKENSKRWNPEIQYTSNYYKSNVEFAVSTEGVYSEPRPIGTRYLTRNL* |
| hu.31-F | 685 | WELQKENSKRWNPEIQYTSNYYKSNVEFAVSTEGVYSEPPIGTRYLTRNL* |

METHODS AND COMPOSITIONS FOR MODULATING THE INTERACTION BETWEEN ADENO-ASSOCIATED VIRUS (AAV) AND THE AAV RECEPTOR (AAVR) FOR ALTERED BIO-DISTRIBUTION OF AAV

CROSS-REFERENCE TO RELATED APPLICATIONS

This application is a National Stage entry of PCT/US2020/050027, filed on Sep. 9, 2020, which claims the benefit of U.S. Provisional Patent Application No. 62/897,973 filed on Sep. 9, 2019 and U.S. Provisional Patent Application No. 62/934,996 filed on Nov. 13, 2019, the entire contents of each of which are incorporated herein by reference.

TECHNICAL FIELD

This disclosure generally relates to viruses, and, specifically, adeno-associated viruses (AAVs).

INCORPORATION BY REFERENCE

The instant application contains an Appendix, which has been submitted via EFS-Web and is hereby incorporated by reference in its entirety. The PDF file, created on Sep. 9, 2020, is named Sequence Appendix.pdf and is 65.9 kilobytes in size.

BACKGROUND

The adeno-associated virus (AAV), when rendered replication-defective, can be used as a vector system for therapeutic gene transfer. AAV is composed of a protein shell called a capsid that encapsulates a single-stranded DNA. The minimal requirements for the DNA molecule to enable encapsulation are that the DNA must be single-stranded and it must include flanking inverted terminal repeats (ITRs) of AAV. The capsid structure is a large multi-protein assembly that forms a globular particle with 20 facets composed of three 60-protein monomers in the form of an icosahedral assembly. These monomers form the capsid proteins. There are three capsid proteins, VP1, VP2, and VP3, which have overlapping sequences. VP3 is the shortest protein and makes up the primary particle structure, i.e., the essential building block to form the icosahedral assembly. VP2 is a longer protein that wholly encompasses VP3 in its C-terminus and is extended on the N-terminus. Similarly, VP1 encompasses VP2 and VP3 at its C-terminus. While VP1 and VP2 are not required structurally to form the capsid, both are required for infectivity of AAV.

In general, the capsid is thought to be the primary determinant of infectivity and host-vector related properties such as adaptive immune responses, tropism, specificity, potency, and bio-distribution. Indeed, several of these properties are known to vary between natural and engineered AAV serotypes and variants. To date, however, there is no mechanistic understanding as to how these changes on the capsid functionally alter these properties, and therefore, there is no rational basis to engineer AAVs toward any level of control of these properties. For example, several therapeutic approaches use AAV via a systemic injection to target global musculature for neuromuscular disorders such as Duchenne Muscular Dystrophy (DMD). However, vectors used currently for these approaches such as AAV9 and rh74 all require high doses to ensure muscle targeting and the vector naturally homes to the liver as a primary target. However, liver tissue is not involved in DMD disease pathology.

In 2016, the research group of Jan Carette identified a protein called AAVR (also known as KIAA0319L) as an essential entry factor or receptor for many AAVs (Pillay et al., 2016, Nature, 530(7588):108-12). In 2019, two independent groups reported on the structural resolution on the parts of the AAV particle that interface with the AAVR receptor (referred to here as the AAVR footprint) (Meyer et al., 2019, Elife, 8 pii: e44707; Zhang et al., 2019, Nat. Microbiol., 4(4):675-682).

SUMMARY

The present disclosure is based, at least in part, on the discovery that one can manipulate, interfere with, or disrupt binding of various AAV to certain specific amino acids at specific locations within the AAVR footprint to alter the bio-distribution of an AAV in a subject, e.g., by modulating, e.g., decreasing or increasing the AAV's transduction of liver cells, without completely inhibiting AAV binding to the liver cells or the ability of the AAV to transduce liver or other cells in a subject.

In one aspect, the disclosure provides methods of modulating the bio-distribution of an adeno-associated virus (AAV) to liver cells within a subject. Such methods include providing an unmodified AAV capsid protein in an AAV; and replacing at least one amino acid residue at one or more of positions Q263, S264, G265, A266, S267, N268, H271, N382, G383, S384, Q385, S446, R471, W502, T503, D528, D529, Q589, K706, or V708 in the capsid protein (numbered relative to the AAV2 capsid sequence (SEQ ID NO:1)) in the AAV with a different amino acid to modify binding between the AAV capsid protein and an AAV receptor (AAVR) on a liver cell in a manner sufficient to alter, but not completely inhibit, the AAV's ability to transduce the liver cell.

In some instances, the bio-distribution to or in the liver cell by the AAV is increased. In other instances, the bio-distribution to or in the liver cell by the AAV is decreased.

In some embodiments, replacing the at least one amino acid residue includes mutagenesis of a nucleic acid encoding the AAV capsid protein. In some instances, the replacing step results in a conservative amino acid substitution.

In another aspect, the disclosure provides methods of modulating the bio-distribution of an adeno-associated virus (AAV) to liver cells within a subject. Such methods include providing an unmodified AAV capsid protein in an AAV; and replacing at least one amino acid residue at one or more of positions S446, R471, or V708 in the capsid protein (numbered relative to the AAV2 capsid sequence (SEQ ID NO:1)) in the AAV with a different amino acid to modify binding between the AAV capsid protein and an AAV receptor (AAVR) on a liver cell in a manner sufficient to alter, but not completely inhibit, the AAV's ability to transduce the liver cell.

In some instances, the AAV's ability to transduce the liver cell is increased, while, in some instances, the AAV's ability to transduce the liver cell is decreased.

In some embodiments, the replaced amino acid residues are any one or more of S446N, S446R, R471A, R471S, V708T, or V708A (numbered relative to the AAV2 capsid sequence (SEQ ID NO:1)). In some embodiments, the replacing of the at least one amino acid residue comprises mutagenesis of a nucleic acid encoding the AAV capsid protein.

In still another aspect, the disclosure provides non-naturally occurring AAV capsid proteins that include an AAV capsid protein having an amino acid sequence that differs from a wild type, unmodified AAV capsid protein amino acid sequence in at least one amino acid residue at a position selected from the group consisting of position 446, 471, or 708 (numbered relative to the AAV2 capsid sequence (SEQ ID NO:1)), where the non-naturally occurring AAV capsid protein amino acid sequence provides an altered binding of the AAV capsid protein for a liver cell than does the wild type AAV sequence in a manner sufficient to alter, but not completely inhibit, the AAV's ability to transduce liver cells.

In some embodiments, the non-naturally occurring amino acid sequence comprises at least one of S446N, S446R, R471A, R471S, V708T, or V708A (numbered relative to the AAV2 capsid sequence (SEQ ID NO:1)).

In some instances, the binding of the non-naturally occurring AAV capsid protein for the liver is increased, e.g., when the AAV capsid includes an R at position 446, an A at position 471, or a T at position 708 (numbered relative to AAV2 (SEQ ID NO:1)). In some instances, the binding of the non-naturally occurring AAV capsid protein for the liver is decreased, e.g., when the AAV capsid includes an S at position 446, an S at position 471, or an A at position 708 (numbered relative to AAV2 (SEQ ID NO:1)).

In yet another aspect, the disclosure provides methods of altering the liver targeting of an AAV in a subject. Such methods include administering an AAV that includes a non-naturally occurring AAV capsid protein as described herein to the subject. In some embodiments, the administration is intravenously. In some embodiments, the administration is repeated a plurality of times.

In one aspect, the present disclosure features methods of altering the bio-distribution of an adeno-associated virus (AAV) in a subject, the methods include modulating the affinity or avidity of an AAV to a liver cell by disrupting or interfering with binding of the AAV to an AAV receptor (AAVR) on a liver cell, wherein the disrupting or interfering involves at least one amino acid residue at one or more of positions 263-265, 267, 268, 271, 382-385, 446, 471, 502, 503, 528-529, 589, 706, and 708 (relative to the AAV2 capsid sequence (SEQ ID NO:1 (top sequence in FIG. 1))).

In some implementations, the disrupting or interfering comprises mutagenesis. In certain embodiments the disrupting or interfering comprises small molecule binding or a chemical or peptide modification of an AAV capsid protein.

In another aspect, the disclosure features non-naturally occurring AAV capsid proteins, including an AAV capsid having a recombinant amino acid sequence that differs from a wild type or unmodified sequence in at least one amino acid residue at a position selected from the group consisting of positions 263-265, 267, 268, 271, 382-385, 446, 471, 502, 503, 528-529, 589, 706, and 708 (relative to the AAV2 capsid sequence (SEQ ID NO:1 (top sequence in FIG. 1))), wherein the recombinant AAV amino acid sequence provides an altered affinity or avidity of the capsid protein for a liver cell than does the wild type AAV sequence.

In some implementations, the at least one amino acid residue that differs between the recombinant amino acid sequence and the wild type sequence is shown in Table 1.

In certain embodiments, the affinity or avidity of the non-naturally occurring AAV capsid protein for the liver is increased. In some implementations, the AAV capsid comprises a R at position 446 or a T at position 708 (relative to AAV2).

In certain embodiments, the affinity or avidity of the non-naturally occurring AAV capsid protein for the liver is decreased. In certain embodiments, the AAV capsid comprises an S at position 446 or an A at position 708 (relative to AAV2).

In another aspect, the disclosure features methods of altering the liver targeting of an AAV in a subject, the methods include administering an AAV comprising the non-naturally occurring AAV capsid protein described herein to the subject.

In yet another aspect, the disclosure features methods of altering the liver targeting of an AAV in a subject, the methods include administering an AAV comprising the non-naturally occurring AAV capsid protein described herein to the subject.

In one aspect, the disclosure provides viruses including a non-naturally occurring, modified AAV VP1 capsid protein. Typically, viruses as described herein include an amino acid sequence having at least 95% sequence identity to an amino acid sequence of an unmodified AAV VP1 capsid protein when the amino acid sequence of the modified AAV capsid protein and the amino acid sequence of the unmodified AAV VP1 capsid protein are aligned using a basic local alignment search tool (BLAST) program with default algorithm parameters; where the amino acid sequence of the modified VP1 capsid protein differs from the amino acid sequence of the unmodified VP1 capsid protein in at least one amino acid position selected from the group consisting of amino acid positions Q263, S264, G265, A266, S267, N268, H271, N382, G383, S384, Q385, S446, R471, W502, T503, D528, D529, Q589, K706, and V708, which are numbered relative to AAV2 VP1 capsid protein (SEQ ID NO:1) when SEQ ID NO:1 and the amino acid sequence of the unmodified AAV capsid protein are aligned using the basic local alignment search tool (BLAST) program with default algorithm parameters.

In some embodiments, the default parameters for BLASTP include: parameters automatically adjusted for short input sequences; expect threshold: 10; word size: 3; max matches in a query range: 0; matrix: BLOSUM62; gap costs: existence 11, extension 1; compositional adjustments: conditional compositional score matrix adjustment; and no filters or masks). In some embodiments, the default parameters for BLASTN are: parameters automatically adjusted for short input sequences; expect threshold: 10; word size: 28; max matches in a query range: 0; match/mismatch scores: 1, −2; gap costs: linear; filter: low complexity regions; and mask: for lookup table only.

In some embodiments, the amino acid sequence of the modified VP1 capsid protein includes at least one amino acid residue (e.g., at least two amino acid residues) selected from the group consisting of 446R, 471A, and 708T. In some embodiments, the amino acid sequence of the modified VP1 capsid protein comprises amino acid residues 446R, 471A, and 708T. In some embodiments, the amino acid sequence of the modified VP1 capsid protein comprises at least one amino acid residue (e.g., at least two amino acid residues) selected from the group consisting of 446S, 471S, and 708A. In some embodiments, the amino acid sequence of the modified VP1 capsid protein comprises 446S, 471S, and 708A.

In some embodiments, the amino acid sequence of the modified VP1 capsid protein differs from the amino acid sequence of the unmodified VP1 capsid protein only in one or more of the amino acid positions Q263, S264, G265, A266, S267, N268, H271, N382, G383, S384, Q385, S446, R471, W502, T503, D528, D529, Q589, K706, and V708, and in no other amino acid positions in the unmodified VP1 capsid protein.

In some embodiments, the unmodified VP1 capsid protein is selected from the group consisting of a VP1 capsid protein from AAV1, AAV2, AAV3, AAV6, AAV7, AAV8, AAV9, rh.10, hu.37, LK-03, AAV5, AAV10, Hu68; Anc80; Anc81; Anc82; Anc83; Anc84; Anc94; Anc113; Anc126; Anc127; Anc80L27; Anc80L59; Anc80L60; Anc80L62; Anc80L65; Anc80L33; Anc80L36; Anc80L44; Anc80L1; Anc110; Anc80DI; AAV1 vp1; AAV2 vp1; AAV9vp1; Anc80; Anc126; Anc127; AAV3; AAV7; AAV8; rh10; hu37; and hu.68.

In certain embodiments, the non-naturally occurring, modified AAV VP1 capsid protein includes an amino acid sequence having at least 96%, 97%, 98% or 99% sequence identity to the amino acid sequence of the unmodified AAV VP1 capsid protein when the amino acid sequence of the modified AAV capsid protein and the amino acid sequence of the unmodified AAV VP1 capsid protein are aligned using a basic local alignment search tool (BLAST) program with default algorithm parameters.

In another aspect, the disclosure provides modified, assembly-competent recombinant AAVs (rAAVs). Such AAVs include VP1, VP2, and VP3 capsid proteins, and a recombinant nucleic acid vector, where the VP1 capsid protein is a modified VP1 capsid protein as described herein.

In still another aspect, the disclosure provides modified, assembly-competent recombinant AAVs (rAAVs). Such AAVs include VP1, VP2, and VP3 capsid proteins; and a recombinant nucleic acid vector, where at least the VP1 capsid protein is a non-naturally occurring, modified VP1 capsid protein comprising an amino acid sequence having at least 95% sequence identity to an amino acid sequence of an unmodified AAV VP1 capsid protein when the amino acid sequence of the modified AAV capsid protein and the amino acid sequence of the unmodified AAV VP1 capsid protein are aligned using a basic local alignment search tool (BLAST) program with default algorithm parameters, and where the modified VP1 capsid protein differs from the unmodified VP1 capsid protein in comprising a means for altering biodistribution of the modified rAAV following administration of the modified rAAV to a first mammalian subject as compared to biodistribution of an unmodified rAAV following administration of the unmodified rAAV having the unmodified VP1 capsid protein to a second mammalian subject of the same type as the first mammalian subject, wherein the unmodified rAAV comprises VP1, VP2, and VP3 capsid proteins having amino acid sequences identical to those of the modified rAAV except for said means.

In some embodiments, the modified rAAV achieves higher transduction of liver cells following administration to a first mammalian subject as compared to transduction of liver cells following administration of the unmodified rAAV including the unmodified VP1 capsid protein to a second mammalian subject of the same type as the first mammalian subject. In some embodiments, the modified rAAV exhibits higher expression in liver cells of an expressible polypeptide encoded by the recombinant nucleic acid vector following administration to a first mammalian subject as compared to expression in liver cells of the expressible polypeptide following administration of an unmodified rAAV including the unmodified VP1 capsid protein to a second mammalian subject of the same type as the first mammalian subject.

In some embodiments, the modified rAAV achieves lower transduction of liver cells following administration to a first mammalian subject as compared to transduction of liver cells following administration of an unmodified rAAV including the unmodified VP1 capsid protein to a second mammalian subject of the same type as the first mammalian subject. In some embodiments, the modified rAAV exhibits lower expression in liver cells of an expressible polypeptide encoded by the recombinant nucleic acid vector following administration to a first mammalian subject as compared to expression in liver cells of the expressible polypeptide following administration of an unmodified rAAV including the unmodified VP1 capsid protein to a second mammalian subject of the same type as the first mammalian subject.

In some embodiments, the modified rAAV has an altered interaction with an AAV receptor (AAVR) expressed on liver cells of the first mammalian subject as compared to an unmodified rAAV including the unmodified VP1 capsid protein with an AAVR expressed on liver cells of the second mammalian subject. In some embodiments, the modified rAAV has increased interaction with an AAV receptor (AAVR) expressed on liver cells of the first mammalian subject as compared to an unmodified rAAV including the unmodified VP1 capsid protein with an AAVR expressed on liver cells of the second mammalian subject. In some embodiments, the modified rAAV has decreased interaction with an AAV receptor (AAVR) expressed on liver cells of the first mammalian subject as compared to an unmodified rAAV including the unmodified VP1 capsid protein with an AAVR expressed on liver cells of the second mammalian subject.

In some embodiments, the first and second mammalian subjects are humans or non-human primates (NHP). In some embodiments, the administration comprises systemic administration, e.g., intravenous infusion. In some embodiments, the modified rAAV has lower liver toxicity when administered to a mammalian subject, e.g., a human subject, than an unmodified rAAV comprising the unmodified VP1 capsid protein administered in the same amount by the same route of administration.

In some embodiments, means for altering biodistribution of the modified rAAV following administration of the modified rAAV to a first mammalian subject includes a mutation at one or more amino acid residues at positions selected from the group consisting of Q263, S264, G265, A266, S267, N268, H271, N382, G383, S384, Q385, S446, R471, W502, T503, D528, D529, Q589, K706, and V708, which are numbered relative to an AAV2 VP1 capsid protein (SEQ ID NO:1) when SEQ ID NO:1 and the amino acid sequence of the unmodified AAV capsid protein are aligned using the basic local alignment search tool (BLAST) program with default algorithm parameters.

In some embodiments, the modified VP1 capsid protein includes at least one amino acid residue (e.g., at least two amino acid residues) selected from the group consisting of 446R, 471A, and 708T. In some embodiments, the modified VP1 capsid protein comprises amino acid residues 446R, 471A, and 708T.

In some embodiments, the modified VP1 capsid protein includes at least one amino acid residue (e.g., at least two amino acid residues) selected from the group consisting of 446S, 471S, and 708A. In some embodiments, the modified VP1 capsid protein includes amino acid residues 446S, 471S, and 708A.

In some embodiments, the amino acid sequence of the modified VP1 capsid protein differs from the amino acid sequence of the unmodified VP1 capsid protein only in one or more of the amino acid positions Q263, S264, G265, A266, S267, N268, H271, N382, G383, S384, Q385, S446, R471, W502, T503, D528, D529, Q589, K706, and V708, and in no other amino acid positions in the unmodified VP1 capsid protein.

In some embodiments, the unmodified VP1 capsid protein is selected from the group consisting of a VP1 capsid protein from AAV1, AAV2, AAV3, AAV6, AAV7, AAV8, AAV9, rh.10, hu.37, LK-03, AAV5, AAV10, Hu68; Anc80; Anc81; Anc82; Anc83; Anc84; Anc94; Anc113; Anc126; Anc127; Anc80L27; Anc80L59; Anc80L60; Anc80L62; Anc80L65; Anc80L33; Anc80L36; Anc80L44; Anc80L1; Anc110; Anc80DI; AAV1 vp1; AAV2 vp1; AAV9vp1; Anc80; Anc126; Anc127; AAV3; AAV7; AAV8; rh10; hu37; and hu.68.

In some embodiments, the amino acid sequence of the modified VP1 capsid protein is at least 96% identical, 97% identical, 98% identical, or 99% identical to the amino acid sequence of the unmodified VP1 capsid protein.

In yet another aspect, pharmaceutical compositions are provided that include a modified rAAV as described herein, and a pharmaceutically acceptable carrier. In one aspect, nucleic acid molecules encoding a modified VP1 capsid protein as described herein or the VP1 protein of a modified rAAV as described herein.

In another aspect, vectors are provided that include a nucleic acid molecule as described herein. In another aspect, isolated host cells are provided that include a nucleic acid molecule as described herein or a vector as described herein.

In still another aspect, the disclosure provides methods of altering delivery of an expressible polynucleotide to a target organ of a mammalian subject (e.g., a human patient), e.g., as compared to delivery using an rAAV with an unmodified VP1 capsid protein. Such methods can include administering a therapeutically effective dose of a modified rAAV as described herein or a pharmaceutical composition as described herein to the human patient. In some embodiments, the expressible nucleic acid is a transgene.

In some embodiments, the modified rAAV exhibits higher transduction of an expressible polypeptide encoded by the recombinant nucleic acid vector into cells of the target organ following administration to a first mammalian subject as compared to transduction into cells of the target organ of the expressible polypeptide following administration of an unmodified rAAV comprising the unmodified VP1 capsid protein to a second corresponding mammalian subject.

In certain embodiments, the modified rAAV exhibits lower transduction of an expressible polypeptide encoded by the recombinant nucleic acid vector into cells of the target organ following administration to a first mammalian subject as compared to transduction into cells of the target organ of the expressible polypeptide following administration of an unmodified rAAV comprising the unmodified VP1 capsid protein to a second corresponding mammalian subject.

In some embodiments, the modified rAAV exhibits higher transduction of an expressible polypeptide encoded by the recombinant nucleic acid vector into cells outside of the target organ following administration to a first mammalian subject as compared to transduction into cells outside of the target organ of the expressible polypeptide following administration of an unmodified rAAV comprising the unmodified VP1 capsid protein to a second corresponding mammalian subject.

In some embodiments, the modified rAAV exhibits lower transduction of an expressible polypeptide encoded by the recombinant nucleic acid vector into cells outside of the target organ following administration to a first mammalian subject as compared to transduction into cells outside of the target organ of the expressible polypeptide following administration of an unmodified rAAV comprising the unmodified VP1 capsid protein to a second corresponding mammalian subject.

In certain embodiments, the modified rAAV exhibits higher expression of an expressible polypeptide encoded by the recombinant nucleic acid vector in cells in cells of the target organ following administration to a first mammalian subject as compared to expression in cells of the target organ of the expressible polypeptide following administration of an unmodified rAAV comprising the unmodified VP1 capsid protein to a second corresponding mammalian subject.

In some embodiments, the modified rAAV exhibits lower expression of an expressible polypeptide encoded by the recombinant nucleic acid vector in cells of the target organ following administration to a first mammalian subject as compared to expression in cells of the target organ of the expressible polypeptide following administration of an unmodified rAAV comprising the unmodified VP1 capsid protein to a second corresponding mammalian subject.

In some embodiments, the modified rAAV exhibits higher expression in cells outside of the target organ of an expressible polypeptide encoded by the recombinant nucleic acid vector following administration to a first mammalian subject as compared to expression in cells of the target organ of the expressible polypeptide following administration of an unmodified rAAV comprising the unmodified VP1 capsid protein to a second corresponding mammalian subject.

In certain embodiments, the modified rAAV exhibits lower expression in cells outside of the target organ of an expressible polypeptide encoded by the recombinant nucleic acid vector following administration to a first mammalian subject as compared to expression in cells of the target organ of the expressible polypeptide following administration of an unmodified rAAV comprising the unmodified VP1 capsid protein to a second corresponding mammalian subject.

In some embodiments, the target organ is the liver. In some embodiments, cells outside the target organ are muscle cells.

In some embodiments, the unmodified AAV is AAV1, AAV8, or AAV9, and the target organ, to which delivery is altered, is the heart; the unmodified AAV is AAV2, and the target organ, to which delivery is altered, is the kidney; the unmodified AAV is AAV7, AAV8, AAV9, and the target organ, to which delivery is altered, is the liver; the unmodified AAV is AAV4, AAV5, AAV6, AAV9, and the target organ, to which delivery is altered, is the lung; the unmodified AAV is AAV8, and the target organ, to which delivery is altered, is the pancreas; the unmodified AAV is AAV2, AAV5, AAV8, and the target organ, to which delivery is altered, is the photoreceptor cells of the eye; the unmodified AAV is AAV1, AAV2, AAV4, AAV5, AAV8, and the target organ, to which delivery is altered, is the Retinal Pigment Epithelium (RPE); and the unmodified AAV is AAV1, AAV6, AAV7, AAV8, AAV9, and the target organ, to which delivery is altered, is the skeletal muscle.

In some embodiments, the modified rAAV has lower liver toxicity when administered to a mammalian subject, e.g., a human subject, than the same dose of an unmodified rAAV comprising the unmodified VP1 capsid protein administered by the same route of administration. In some embodiments, the mammalian subject is a human subject or a non-human primate.

In still another aspect, the disclosure provides compositions for use in any of the methods described herein.

In one aspect, in a method of treating a mammalian subject (e.g., a human patient) by administering a recombinant AAV (rAAV), the improvement includes administering a therapeutically effective dose of a modified rAAV that comprises a capsid having means for altering rAAV biodistribution following administration to a mammalian subject.

In some embodiments, the means for altering rAAV biodistribution reduce liver clearance of the rAAV. In some embodiments, the means for altering rAAV biodistribution increase transduction of cells of a target organ. In some embodiments, the means for altering rAAV biodistribution increase expression in cells of a target organ of an expressible polypeptide encoded by the recombinant nucleic acid vector. In some embodiments, the means for altering rAAV biodistribution decrease transduction of cells of a target organ. In some embodiments, the means for altering rAAV biodistribution decrease expression in cells of a target organ of an expressible polypeptide encoded by the recombinant nucleic acid vector. In some embodiments, the means for altering rAAV biodistribution increase transduction of cells outside of a target organ.

In certain embodiments, the means for altering rAAV biodistribution increase expression in cells outside of a target organ of an expressible polypeptide encoded by the recombinant nucleic acid vector. In some embodiments, the means for altering rAAV biodistribution decrease transduction of cells outside of a target organ. In some embodiments, the means for altering rAAV biodistribution decrease expression in cells outside of a target organ of an expressible polypeptide encoded by the recombinant nucleic acid vector. In some embodiments, the means for altering rAAV biodistribution alter interaction of the modified rAAV with the AAVR expressed on cells of the mammalian subject. In some embodiments, the means for altering rAAV biodistribution reduce interaction of the modified rAAV with the AAVR. In some embodiments, the means for altering rAAV biodistribution increase interaction of the modified rAAV with the AAVR. In some embodiments, the modified rAAV has less liver toxicity than the unmodified rAAV.

In certain embodiments, the modified rAAV achieves a 10-fold reduction in gene transfer to liver cells after a first administration into a mammalian subject compared to an unmodified rAAV. In some embodiments, the modified rAAV achieves a 10-fold increase in gene transfer to liver cells after a first administration into a rhesus macaque compared to an unmodified rAAV.

In some embodiments, the modified rAAV achieves a 100-fold increase in gene transfer to liver cells following the first administration into a mammalian subject. In some embodiments, the modified rAAV achieves a 100-fold decrease in gene transfer to liver cells following the first administration into a mammalian subject.

In certain embodiments, the modified rAAV achieves a 1000-fold increase in gene transfer to liver cells following the first administration into a mammalian subject. In some embodiments, the modified rAAV achieves a 1000-fold decrease in gene transfer to liver cells following the first administration into a mammalian subject.

The term "mutation" refers to a change or alteration in the native or natural sequence or a nucleic acid or an amino acid. A mutation can be naturally occurring or a mutation can be engineered in the laboratory (e.g., man-made).

The term "unmodified AAV capsid protein" as used herein refers to a VP1, VP2, or VP3 capsid protein of a naturally occurring AAV serotype or a non-naturally occurring VP1, VP2, or VP3 capsid protein available or known in the art. The non-naturally occurring VP1, VP2, or VP3 capsid protein includes a capsid protein generated by biological or chemical alteration or variation of a naturally occurring AAV capsid protein. Accordingly, unmodified AAV capsid proteins include, but are not limited to, a capsid protein of various AAV serotypes (e.g., AAV1, AAV2, AAV3B, AAV5, AAV6, AAV8, and AAV9) or a variant thereof. As used herein, "variant" refers to a naturally occurring or artificially created relative of the indicated serotype available or known in the art. A non-naturally occurring VP1, VP2, or VP3 capsid protein further includes an artificial capsid protein created by in silico design or synthesis. An artificial capsid protein includes, but is not limited to, AAV capsid proteins disclosed in PCT/US2014/060163, U.S. Pat. No. 9,695,220, PCT/US2016/044819, PCT/US2018/032166, PCT/US2019/031851, and PCT/US2019/047546, which are incorporated herein by reference in their entireties.

Representative unmodified AAV capsid proteins can be VP1, VP2 or VP3 capsid proteins of an AAV selected from, without limitation, AAV2 (SEQ ID NO:1); AAV1 (SEQ ID NO:4); AAV6 (SEQ ID NO:5); AAV3 (SEQ ID NO:6); AAV LK03 (SEQ ID NO:7); AAV7 (SEQ ID NO:8); AAV8 (SEQ ID NO:9); AAV hu.37 (SEQ ID NO:10); AAV rh.10 (SEQ ID NO:11); AAV9 (SEQ ID NO:12); AAV hu.68 (SEQ ID NO:13); AAV10 (SEQ ID NO:14); AAV5 (SEQ ID NO:15); AAV3-3 (SEQ ID NO:16); AAV4-4 (SEQ ID NO:17); AAV1-A (SEQ ID NO:18); hu. 46-A (SEQ ID NO:19); hu. 48-A (SEQ ID NO:20); hu. 44-A (SEQ ID NO:21); hu. 43-A (SEQ ID NO:22), AAV6-A (SEQ ID NO:23); hu. 34-B (SEQ ID NO:24), hu. 47-B (SEQ ID NO:25), hu. 29-B (SEQ ID NO:26), rh. 63-B (SEQ ID NO:27), hu. 56-B (SEQ ID NO:28), hu. 45-B (SEQ ID NO:29), rh. 57-B (SEQ ID NO:30), rh. 35-B (SEQ ID NO:31); rh. 58-B (SEQ ID NO:32); rh. 28-B (SEQ ID NO:33); rh. 51-B (SEQ ID NO:34); rh. 19-B (SEQ ID NO:35); rh. 49-B (SEQ ID NO:36), rh. 52-B (SEQ ID NO:37); rh. 13-B (SEQ ID NO:38); AAV2-B (SEQ ID NO:39); rh. 20-B (SEQ ID NO:40); rh. 24-B (SEQ ID NO:41); rh. 64-B (SEQ ID NO:42); hu. 27-B (SEQ ID NO:43); hu. 21-B (SEQ ID NO:44); hu. 22-B (SEQ ID NO:45); hu. 23-B (SEQ ID NO:46); hu. 7-C(SEQ ID NO:47); hu. 61-C(SEQ ID NO:48); rh. 56-C(SEQ ID NO:49); hu. 9-C(SEQ ID NO:59); hu. 54-C(SEQ ID NO:51); hu. 53-C(SEQ ID NO:52); hu. 60-C(SEQ ID NO:53); hu. 55-C(SEQ ID NO:54); hu. 2-C (SEQ ID NO:55); hu. 1-C(SEQ ID NO:56); hu. 18-C (SEQ ID NO:57); hu. 3-C(SEQ ID NO:58); hu. 25-C(SEQ ID NO:59); hu. 15-C(SEQ ID NO:60); hu. 16-C(SEQ ID NO:61); hu. 11-C(SEQ ID NO:62); hu. 10-C(SEQ ID NO:63); hu. 4-C(SEQ ID NO:64); rh. 54-D (SEQ ID NO:65); rh. 48-D (SEQ ID NO:66); rh. 55-D (SEQ ID NO:67); rh. 62-D (SEQ ID NO:68); AAV7-D (SEQ ID NO:69); rh. 52-E (SEQ ID NO:70); rh. 51-E (SEQ ID NO:71); hu. 39-E (SEQ ID NO:72); rh. 53-E (SEQ ID NO:73); hu. 37-E (SEQ ID NO:74); rh. 43-E (SEQ ID NO:75); rh. 50-E (SEQ ID NO:76); rh. 49-E (SEQ ID NO:77); rh. 61-E (SEQ ID NO:78); hu. 41-E (SEQ ID NO:79); rh. 64-E (SEQ ID NO:80); hu. 42-E (SEQ ID NO:81); rh. 57-E (SEQ ID NO:82); rh. 40-E (SEQ ID NO:83); hu. 67-E (SEQ ID NO:84); hu. 17-E (SEQ ID NO:85); hu. 6-E (SEQ ID NO:86); hu. 66-E (SEQ ID NO:87); rh. 38-E (SEQ ID NO:88); hu. 32-F (SEQ ID NO:89); AAV9/hu (SEQ ID NO:90); hu. 31-F (SEQ ID NO:91); Anc80 (SEQ ID NO:92); Anc81 (SEQ ID NO:93); Anc82 (SEQ ID NO:94); Anc83 (SEQ ID NO:95); Anc84 (SEQ ID NO:96); Anc94 (SEQ ID NO:97); Anc113 (SEQ ID NO:98); Anc126 (SEQ ID NO:99); Anc127 (SEQ ID NO:100); Anc80L27 (SEQ ID NO:101); Anc80L59 (SEQ ID NO:102); Anc80L60 (SEQ ID NO:103); Anc80L62 (SEQ ID NO:104); Anc80L65 (SEQ ID NO:105); Anc80L33 (SEQ ID NO:106); Anc80L36 (SEQ ID NO:107); Anc80L44 (SEQ ID NO:108); Anc80L1 (SEQ ID NO:109); Anc110 (SEQ ID NO:110); and Anc80DI (SEQ ID NO:111).

The term "unmodified rAAV" as used herein refers to a recombinant AAV (rAAV) comprising only unmodified AAV capsid proteins.

Unless otherwise defined, all technical and scientific terms used herein have the same meaning as commonly understood by one of ordinary skill in the art to which the methods and compositions of matter belong. Although methods and materials similar or equivalent to those described herein can be used in the practice or testing of the methods and compositions of matter, suitable methods and materials are described below. In addition, the materials, methods, and examples are illustrative only and not intended to be limiting. All publications, patent applications, patents, and other references mentioned herein are incorporated by reference in their entirety.

DESCRIPTION OF DRAWINGS

FIG. 2 is an alignment of Anc126 (SEQ ID NO:99) and Anc127 (SEQ ID NO:100) VP1 capsid protein sequences relative to the AAV2 capsid protein sequence (SEQ ID NO:1). The residues in the AAV2 capsid sequence predicted to interact with the AAVR footprint (the AAVR binding domain of the AAV capsid protein sequence) are boxed.

FIGS. 7-1 to 7-3 represent an alignment of VP1 capsid proteins that can be used in the methods described herein (AAV2 (SEQ ID NO:1); AAV1 (SEQ ID NO:4); AAV6 (SEQ ID NO:5); AAV3 (SEQ ID NO:6); AAV LK03 (SEQ ID NO:7); AAV7 (SEQ ID NO:8); AAV8 (SEQ ID NO:9); AAV hu.37 (SEQ ID NO:10); AAV rh.10 (SEQ ID NO:11); AAV9 (SEQ ID NO:12); AAV hu.68 (SEQ ID NO:13); AAV10 (SEQ ID NO:14); and AAV5 (SEQ ID NO:15)). The locations of the variable toggle residues described herein are boxed.

FIGS. 8-1 to 8-31 represent an alignment of the amino acid sequences of AAV VP1 capsid proteins that can be used in the methods described herein (AAV5 (SEQ ID NO:15); AAV3-3 (SEQ ID NO:16); AAV4-4 (SEQ ID NO:17); AAV1-A (SEQ ID NO:18); hu. 46-A (SEQ ID NO:19); hu. 48-A (SEQ ID NO:20); hu. 44-A (SEQ ID NO:21); hu. 43-A (SEQ ID NO:22), AAV6-A (SEQ ID NO:23); hu. 34-B (SEQ ID NO:24), hu. 47-B (SEQ ID NO:25), hu. 29-B (SEQ ID NO:26), rh. 63-B (SEQ ID NO:27), hu. 56-B (SEQ ID NO:28), hu. 45-B (SEQ ID NO:29), rh. 57-B (SEQ ID NO:30), rh. 35-B (SEQ ID NO:31); rh. 58-B (SEQ ID NO:32); rh. 28-B (SEQ ID NO:33), rh. 51-B (SEQ ID NO:34); rh. 19-B (SEQ ID NO:35); rh. 49-B (SEQ ID NO:36), rh. 52-B (SEQ ID NO:37); rh. 13-B (SEQ ID NO:38); AAV2-B (SEQ ID NO:39); rh. 20-B (SEQ ID NO:40); rh. 24-B (SEQ ID NO:41); rh. 64-B (SEQ ID NO:42); hu. 27-B (SEQ ID NO:43); hu. 21-B (SEQ ID NO:44); hu. 22-B (SEQ ID NO:45); hu. 23-B (SEQ ID NO:46); hu. 7-C(SEQ ID NO:47); hu. 61-C(SEQ ID NO:48); rh. 56-C (SEQ ID NO:49); hu. 9-C(SEQ ID NO:59); hu. 54-C(SEQ ID NO:51); hu. 53-C(SEQ ID NO:52); hu. 60-C(SEQ ID NO:53); hu. 55-C(SEQ ID NO:54); hu. 2-C (SEQ ID NO:55); hu. 1-C(SEQ ID NO:56); hu. 18-C(SEQ ID NO:57); hu. 3-C(SEQ ID NO:58); hu. 25-C(SEQ ID NO:59); hu. 15-C(SEQ ID NO:60); hu. 16-C (SEQ ID NO:61); hu. 11-C(SEQ ID NO:62); hu. 10-C(SEQ ID NO:63); hu. 4-C(SEQ ID NO:64); rh. 54-D (SEQ ID NO:65); rh. 48-D (SEQ ID NO:66); rh. 55-D (SEQ ID NO:67); rh. 62-D (SEQ ID NO:68); AAV7-D (SEQ ID NO:69); rh. 52-E (SEQ ID NO:70); rh. 51-E (SEQ ID NO:71); hu. 39-E (SEQ ID NO:72); rh. 53-E (SEQ ID NO:73); hu. 37-E (SEQ ID NO:74); rh. 43-E (SEQ ID NO:75); rh. 50-E (SEQ ID NO:76); rh. 49-E (SEQ ID NO:77); rh. 61-E (SEQ ID NO:78); hu. 41-E (SEQ ID NO:79); rh. 64-E (SEQ ID NO:80); hu. 42-E (SEQ ID NO:81); rh. 57-E (SEQ ID NO:82); rh. 40-E (SEQ ID NO:83); hu. 67-E (SEQ ID NO:84); hu. 17-E (SEQ ID NO:85); hu. 6-E (SEQ ID NO:86); hu. 66-E (SEQ ID NO:87); rh. 38-E (SEQ ID NO:88); hu. 32-F (SEQ ID NO:89); AAV9/hu (SEQ ID NO:90); and hu. 31-F (SEQ ID NO:91). The locations of the variable toggle residues described herein are boxed.

FIGS. 9-1 to 9-4 represent an alignment of the amino acid sequences of AAV Anc capsid proteins that can be used in the methods described herein (Anc80 (SEQ ID NO:92), Anc81 (SEQ ID NO:93), Anc82 (SEQ ID NO:94), Anc83 (SEQ ID NO:95), Anc84 (SEQ ID NO:96), Anc94 (SEQ ID NO:97), Anc113 (SEQ ID NO:98), Anc126 (SEQ ID NO:99), Anc127 (SEQ ID NO:100), Anc80L27 (SEQ ID NO:101), Anc80L59 (SEQ ID NO:102), Anc80L60 (SEQ ID NO:103), Anc80L62 (SEQ ID NO:104), Anc80L65 (SEQ ID NO:105), Anc80L33 (SEQ ID NO:106), Anc80L36 (SEQ ID NO:107), Anc80L44 (SEQ ID NO:108); Anc80L1 (SEQ ID NO:109); Anc110 (SEQ ID NO:110), Anc80DI (SEQ ID NO:111).

Figure 1:
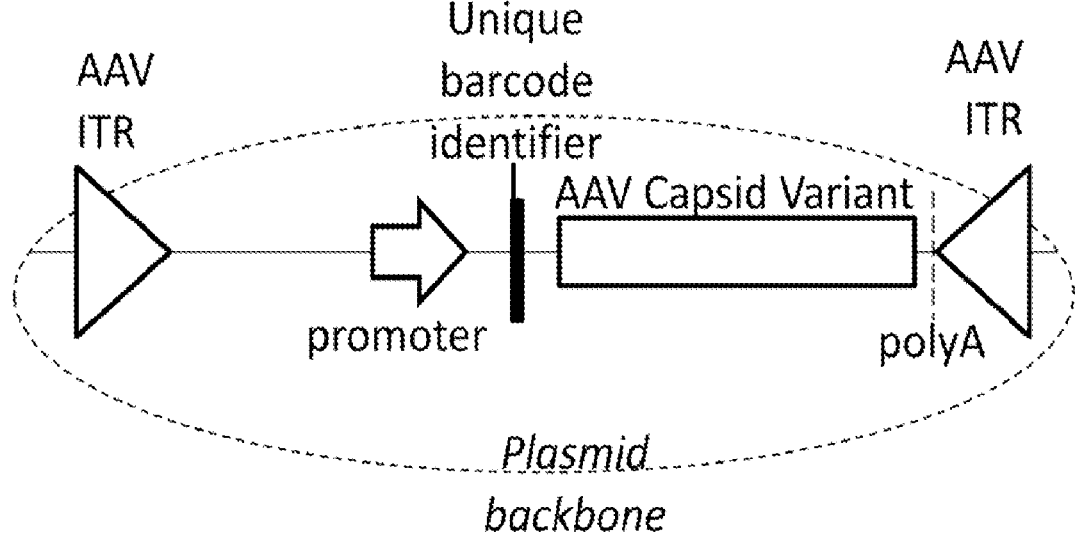
FIG. 1 is a schematic showing a minimal design of a library construct for AAV variants within a pooled barcoded library. ITR, Inverted Terminal Repeat; polyA, poly adenylation signals; ORF, open reading frame.

Among the sequences, SEQ ID NOs: 92-100 are sequences of the ancestral AAV capsid libraries disclosed in U.S. Pat. No. 9,695,220, incorporated by reference in its entirety herein. The libraries include Anc80 (SEQ ID NO:92), Anc81 (SEQ ID NO:93), Anc82 (SEQ ID NO:94), Anc83 (SEQ ID NO:95), Anc84 (SEQ ID NO:96), Anc94

(SEQ ID NO:97), Anc113 (SEQ ID NO:98), Anc126 (SEQ ID NO:99), Anc127 (SEQ ID NO:100). FIGS. 9-1, 9-2, 9-3 and 9-4 were generated using single member sequences (SEQ ID NOs 92-100) of each library, but the same analysis and alignment can be done with any other member of the libraries to identify locations of the variable toggle residues.

The locations of the variable toggle residues described herein are boxed. One or more amino acids in the toggle sites can be substituted, inserted and/or deleted as described herein to achieve a desired AAV biodistribution.

DETAILED DESCRIPTION

The current disclosure indicates that, through various points of interaction between AAV and the AAVR, the bio-distribution of the AAV (e.g., the amount of vector uptake and transduction) to and into cells in the liver and expression of an expressible nucleic acid such as a transgene in target cells can be modulated (e.g., decreased or increased), while maintaining, or even increasing, transduction of cells in other organs and peripheral tissues, such as muscle. This disclosure provides guidance on how to alter AAV capsid protein sequences to modulate the AAVR-AAV interaction in such a way that preserves the ability of AAV to engage with and bind to the AAV receptor for it to functionally enter and transduce a cell, yet changes its affinity, avidity, binding, and dissociation constants, and/or the receptor-ligand kinetics, in a manner sufficient to modify transduction, thus altering the bio-distribution of AAV to cells in the liver and in other organs and tissues, e.g., muscle tissue, within the body following in vivo administration. Based on this disclosure, the sequence of an AAV can be altered to modulate the bio-distribution of the AAV, e.g., by modulating transduction by an AAV of liver cells, without inhibiting binding of the AAV to the liver and other cells, within a patient or subject.

Adeno-Associated Virus (AAV)

Gene transfer, either for experimental or therapeutic purposes, relies upon a vector or vector system to shuttle genetic information into target cells. The vector or vector system is considered the major determinant of efficiency, specificity, host response, pharmacology, and longevity of the gene transfer reaction. Currently, the most efficient and effective way to accomplish gene transfer is through the use of vectors or vector systems based on viruses that have been made replication-defective. Some of the vectors that have shown success as gene therapy vehicles are based on adeno-associated viruses (AAVs).

Viral polypeptides can be assembled into a virus particle using, for example, a packaging host cell. The components of a virus particle (e.g., rep sequences, cap sequences, inverted terminal repeat (ITR) sequences) can be introduced into a packaging host cell using one or more viral vectors as described herein. Once assembled, virus particles can be screened for their ability to target the liver. Methods of determining the ability of an AAV to target the liver are described herein (see, for instance, Example 3).

In addition, virus particles as described herein can be screened for any number of other features or phenotypes (e.g., the ability to replicate; gene transfer properties; receptor binding ability; and/or seroprevalence in a population). In addition, methods of determining whether a virus particle binds to its receptor is known in the art, and such methods can be performed in vitro or in vivo.

Virus particles can be purified, if desired, using routine methods. As used herein, "purified" virus particles refer to virus particles that are removed from components in the mixture in which they were made such as, but not limited to, viral components (e.g., rep sequences, cap sequences), packaging host cells, and partially- or incompletely-assembled virus particles.

AAV Liver Toggle

Previously, a particular position within the AAV VP1 capsid protein was identified that, when toggled between two different amino acids (glycine and alanine) at that position, quantitatively altered liver uptake and expression following intravenous injection of AAV in mice, non-human primates, and mice with humanized livers, as well as co-cultures of human hepatocyte (see, for example, WO 2019/217911, incorporated herein by reference in its entirety). This observation was made initially using an Anc80 AAV variant library; Anc80 is a predicted ancestral AAV scaffold sequence (see, for example, WO 2015/054653, incorporated herein by reference in its entirety). This observation is significant, because this particular residue change (G to A, or A to G) is one of the most conservative amino acid substitutions possible, yet such a conservative change still imparts very distinct liver-on/liver-off toggling.

Further work extended the relevance of this conserved toggle to other AAV viruses including natural AAV variants, AAV3B and AAV9, in which the natural variant was in "liver off" or "liver on" position, respectively. Based on this work, each liver state could be converted into the opposite state by making the indicated amino-acid substitution (see, for example, WO 2019/217911). In addition, data on the liver toggle "off" variants of Anc80 and AAV9 demonstrated that, while liver targeting is substantially reduced, uptake in non-liver tissues such as muscle is preserved quantitatively or, in certain cases, increased.

It would be appreciated by a skilled artisan that identifying and changing one or more of the "liver toggle" sequences described herein (e.g., to change an AAV from a liver-on to a liver-off, or vice versa) requires that the context of a sequence, sometimes due to the context of a resulting structural feature, be preserved. For at least that reason, the numbering of the positions referred to herein is relative to the sequence of the AAV2 VP1 protein, which is shown in SEQ ID NO:1. It would be understood, however, that any AAV, whether naturally occurring such as AAV1, AAV2, AAV3, AAV5, AAV6, AAV7, AAV9, AAV9, rh.10, hu.37, LK-03, AAV5, AAV10, and Hu68, or modified or variant such as AAV ShH10, and AAV-DJ, as well as variants such as the Anc80 AAV variant library (see, for example, WO 2015/054653) Anc80; Anc81; Anc82; Anc83; Anc84; Anc94; Anc113; Anc126; Anc127; Anc80L27; Anc80L59; Anc80L60; Anc80L62; Anc80L65; Anc80L33; Anc80L36; Anc80L44; Anc80L1; Anc110; Anc80DI, could be used as an unmodified sequence, i.e., reference sequence, although the numerical position may change from those referred to herein if a different reference sequence is used.

The context of a sequence, or the position of one or more amino acids in one sequence relative to another, typically is determined using a sequence alignment algorithm (e.g., Altschul et al., 1997, Nucleic Acids Res., 25:3389 3402 as incorporated into BLAST (basic local alignment search tool) programs, available at ncbi.nlm.nih.gov on the World Wide Web). BLAST or similar algorithms can be used to align two sequences (e.g., to identify the residue at a "corresponding" position, even if the two sequences differ, for example, in length), to identify motifs or consensus sequences, and/or to determine percent sequence identity between two or more sequences (nucleic acid or amino acid).

As used herein, "default parameters" used when comparing two sequences are the default parameters using the BLAST algorithm (Version BLAST+2.10.1) as implemented at blast.ncbi.nlm.nih.gov on the World Wide Web on Sep. 9, 2020. For aligning protein sequences, the default parameters are BLASTP: parameters automatically adjusted for short input sequences; expect threshold: 10; word size: 3; max matches in a query range: 0; matrix: BLOSUM62; gap costs: existence 11, extension 1; compositional adjustments: conditional compositional score matrix adjustment; and no filters or masks). For aligning nucleic acid sequences, the default parameters are BLASTN: parameters automatically adjusted for short input sequences; expect threshold: 10; word size: 28; max matches in a query range: 0; match/mismatch scores: 1, −2; gap costs: linear; filter: low complexity regions; and mask: for lookup table only.

Figures 2, 7:
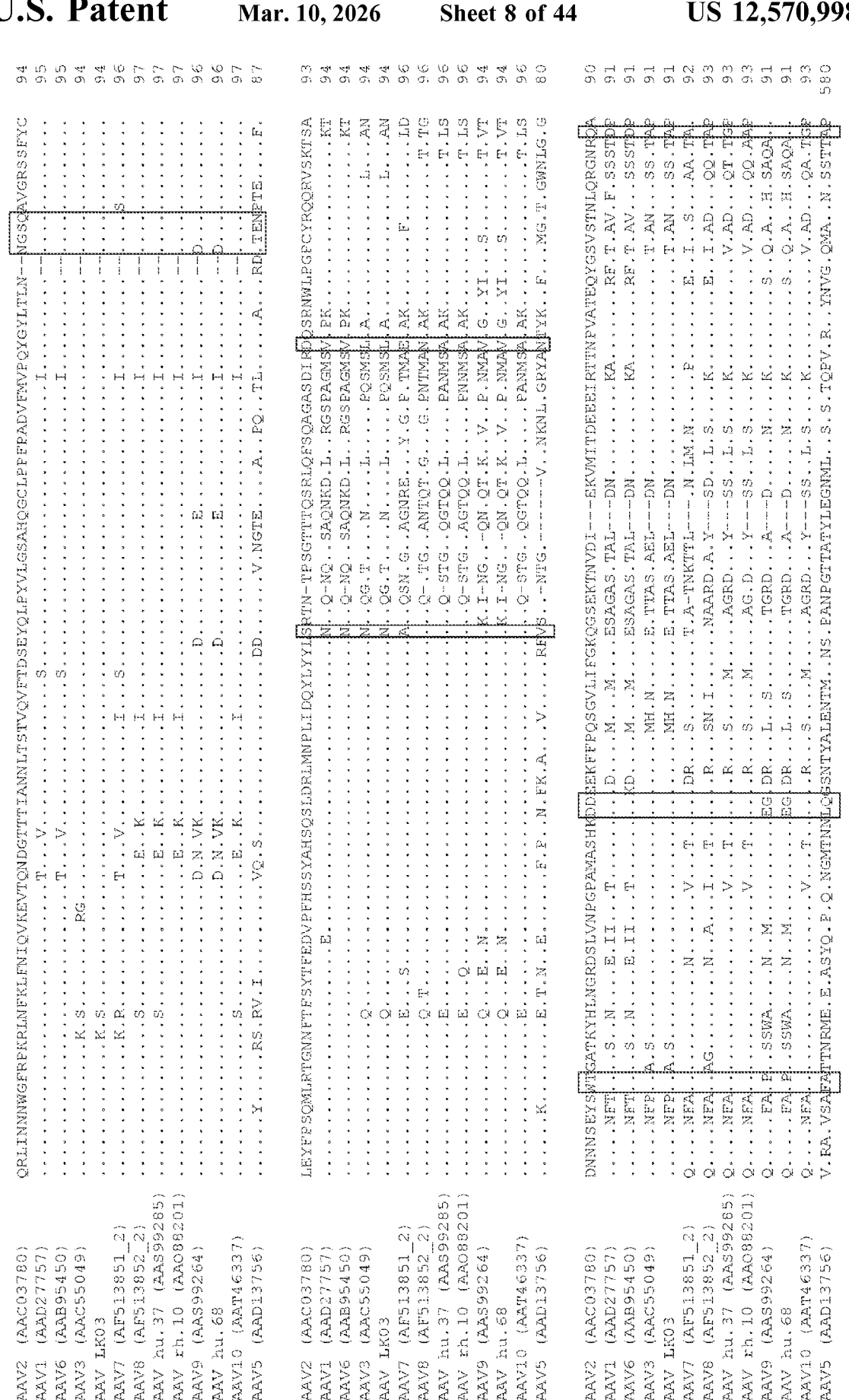
Figures 1, 8:
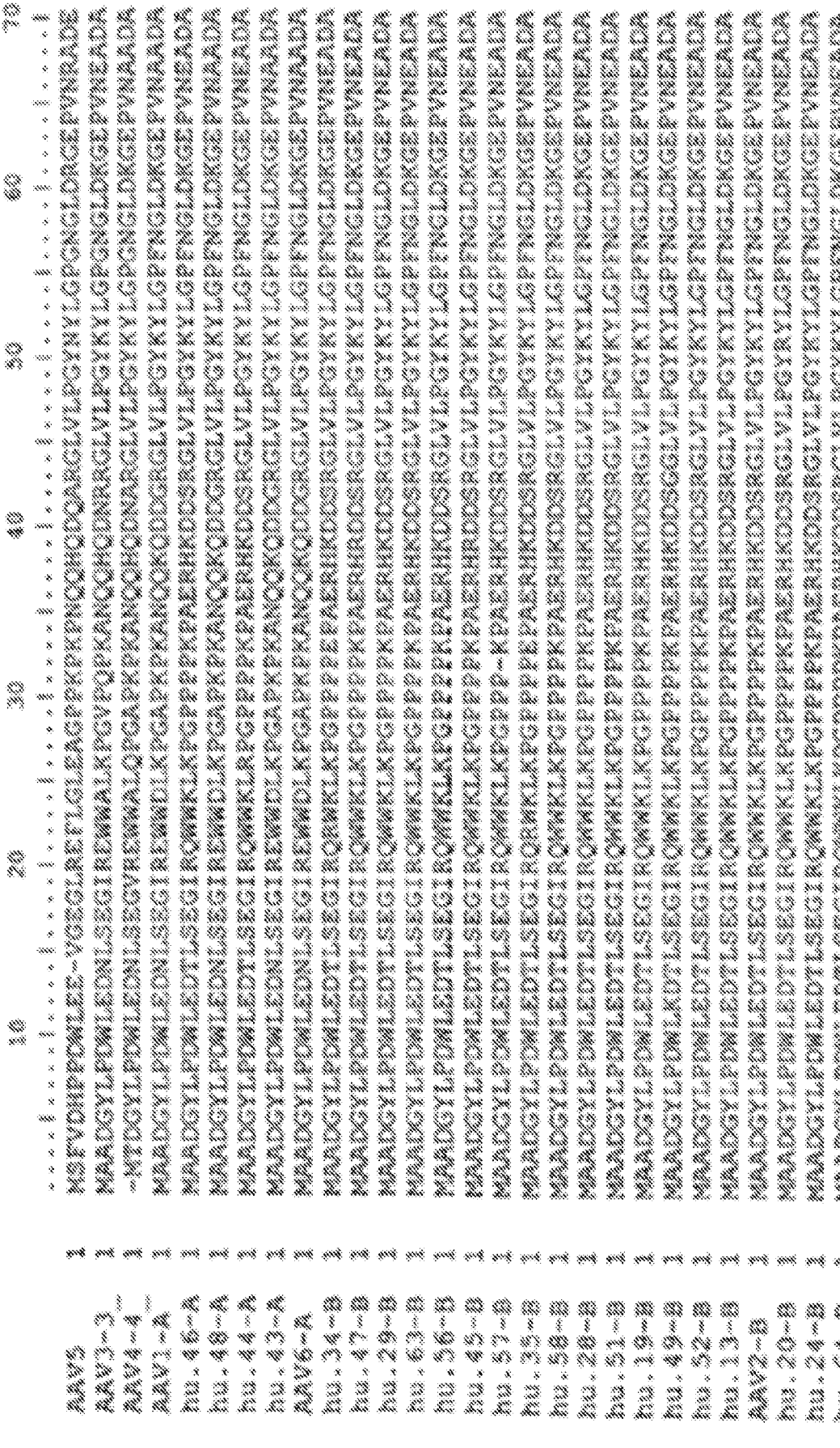
Figures 8, 9:
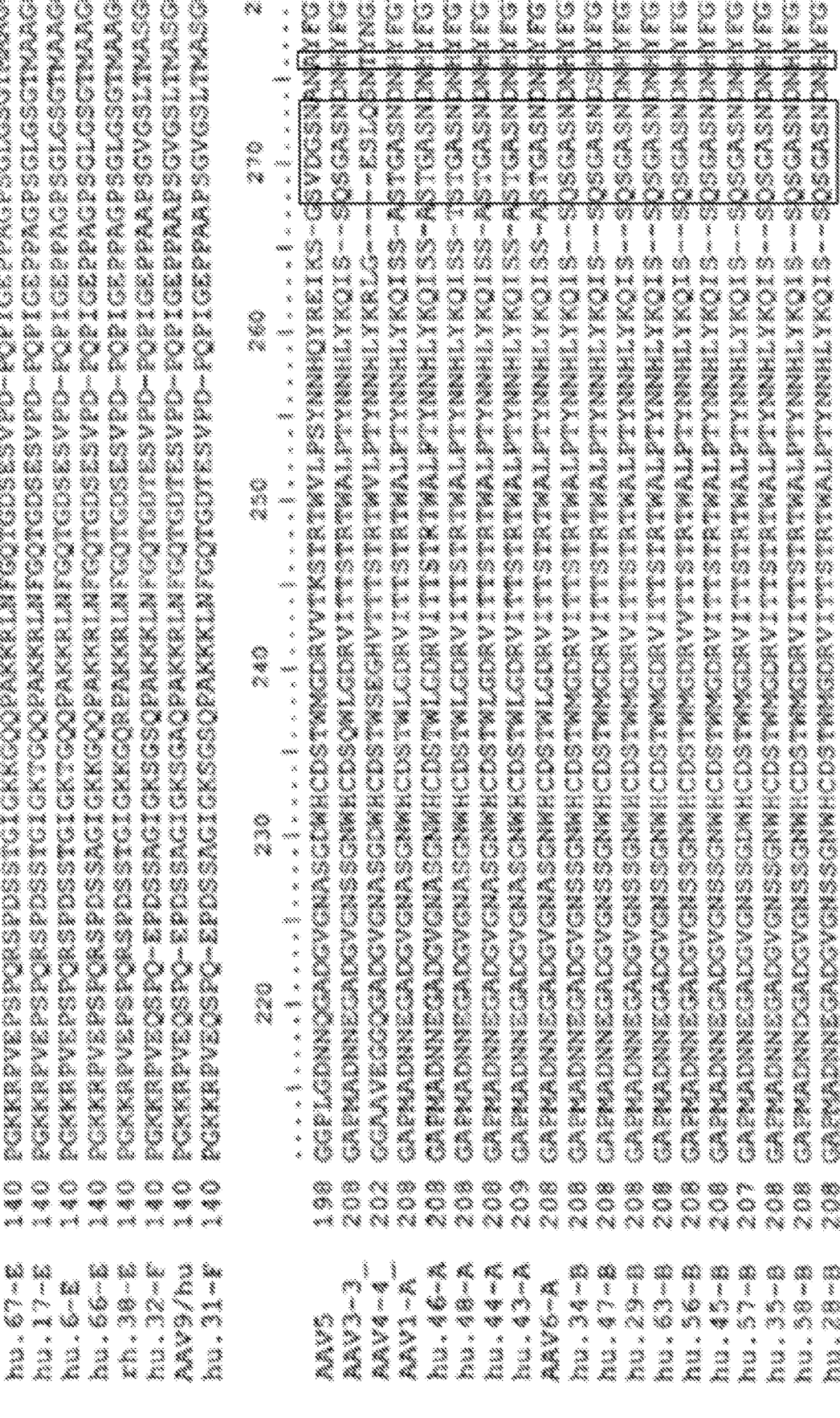
Figures 8, 9, 10:
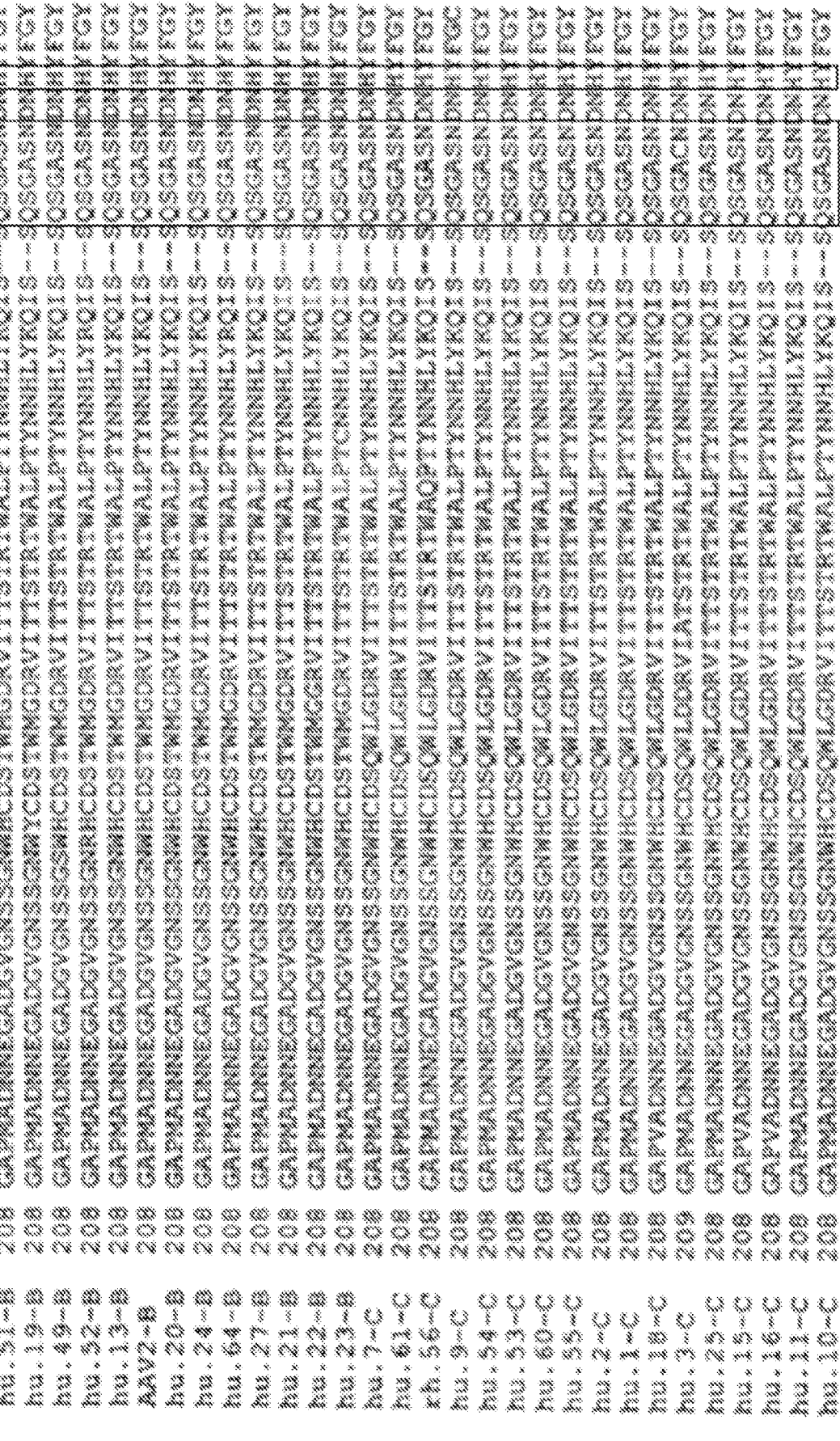
Figures 8, 9, 10, 11:
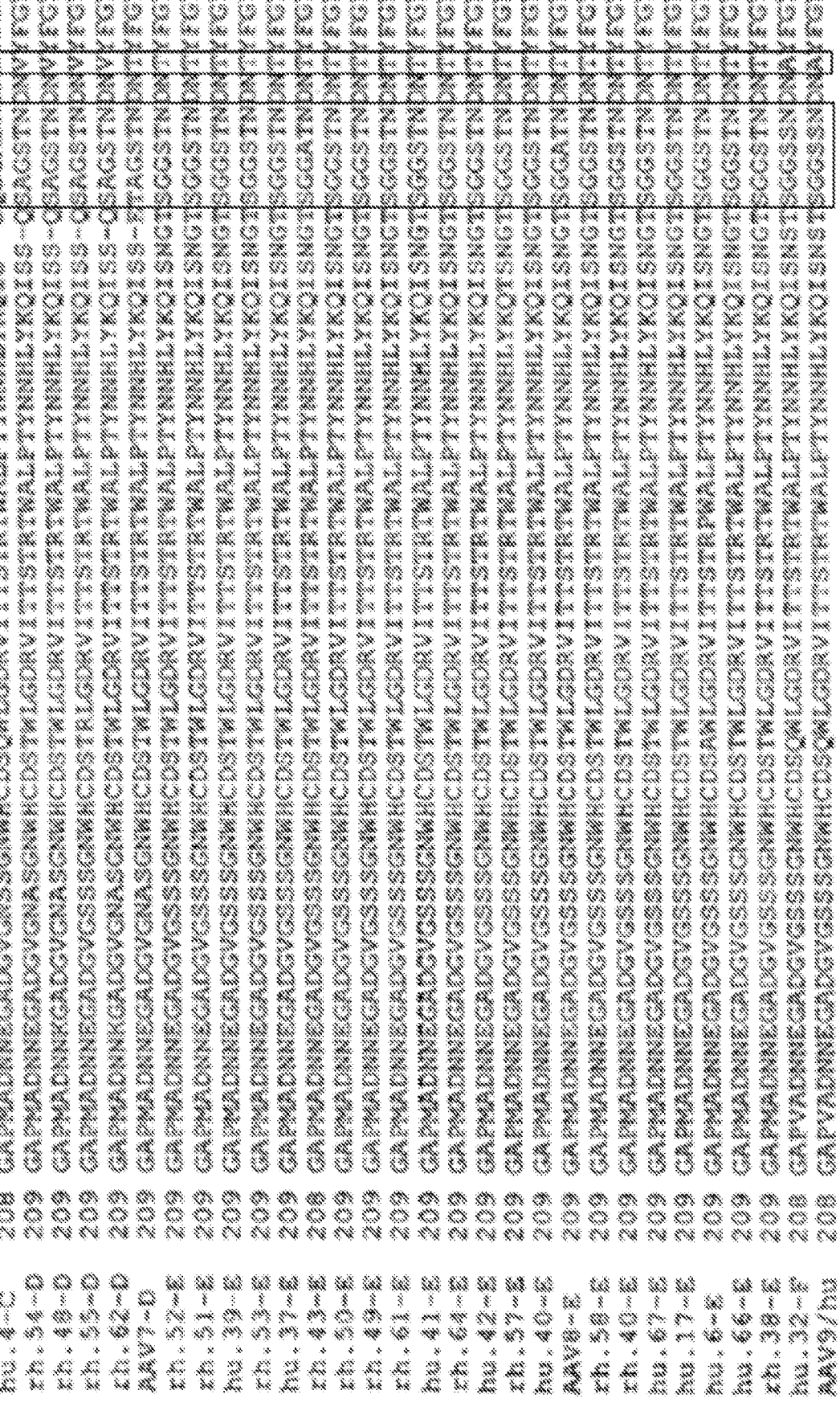
Figures 8, 9, 10, 11, 12, 13, 14:
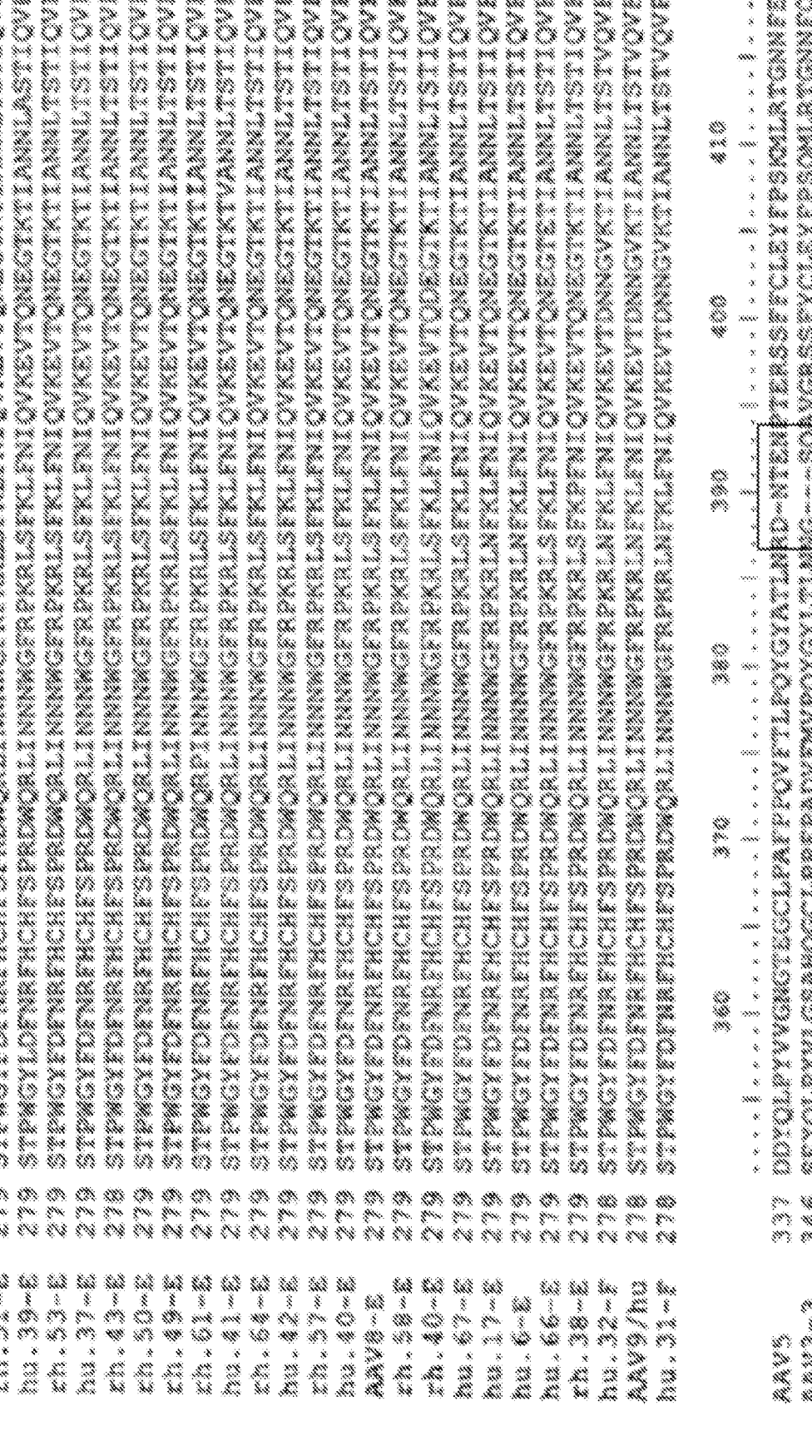
Figures 8, 9, 10, 11, 12, 13, 14, 15:
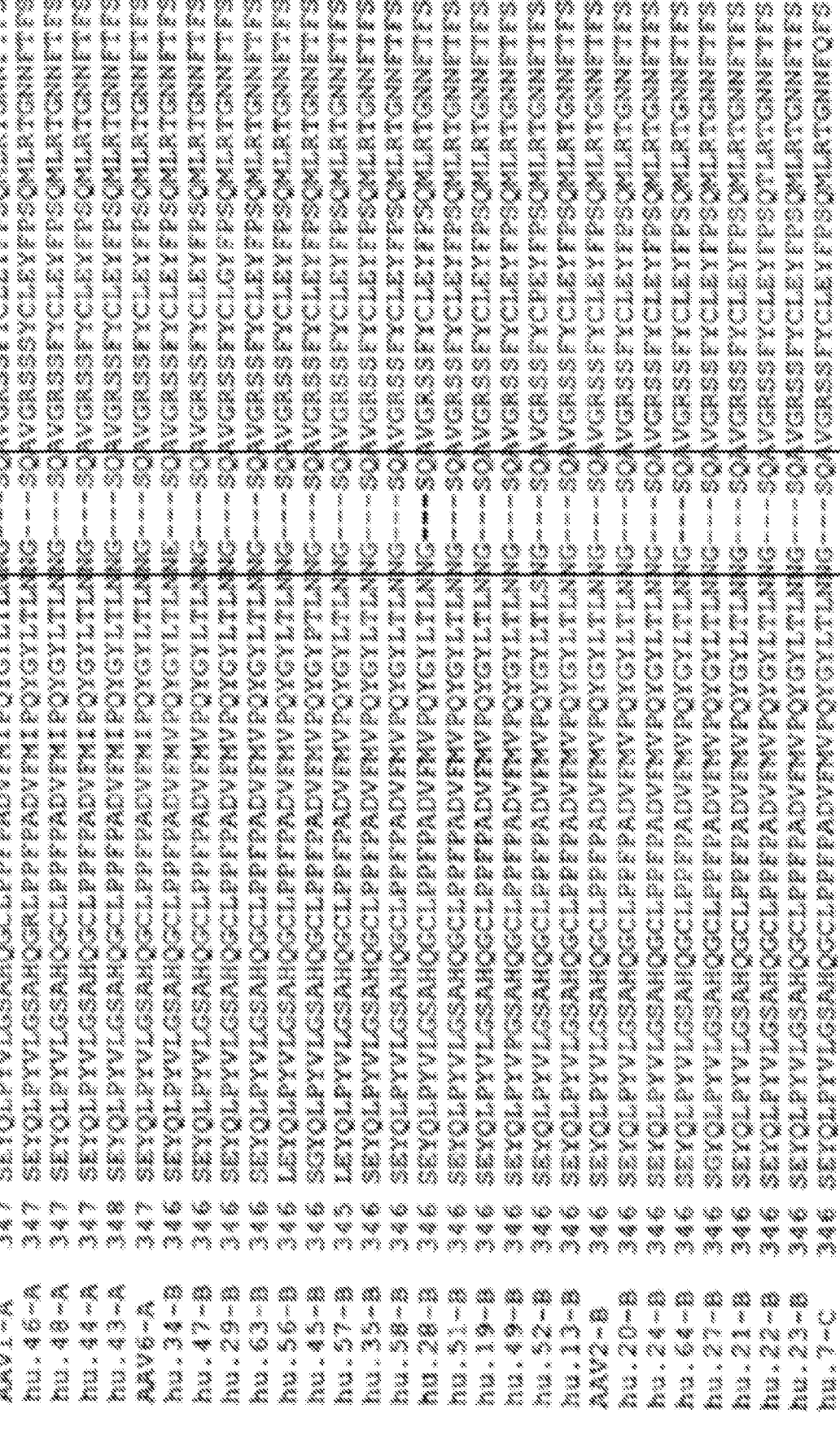
Figures 8, 9, 10, 11, 12, 13, 14, 15, 16, 17:
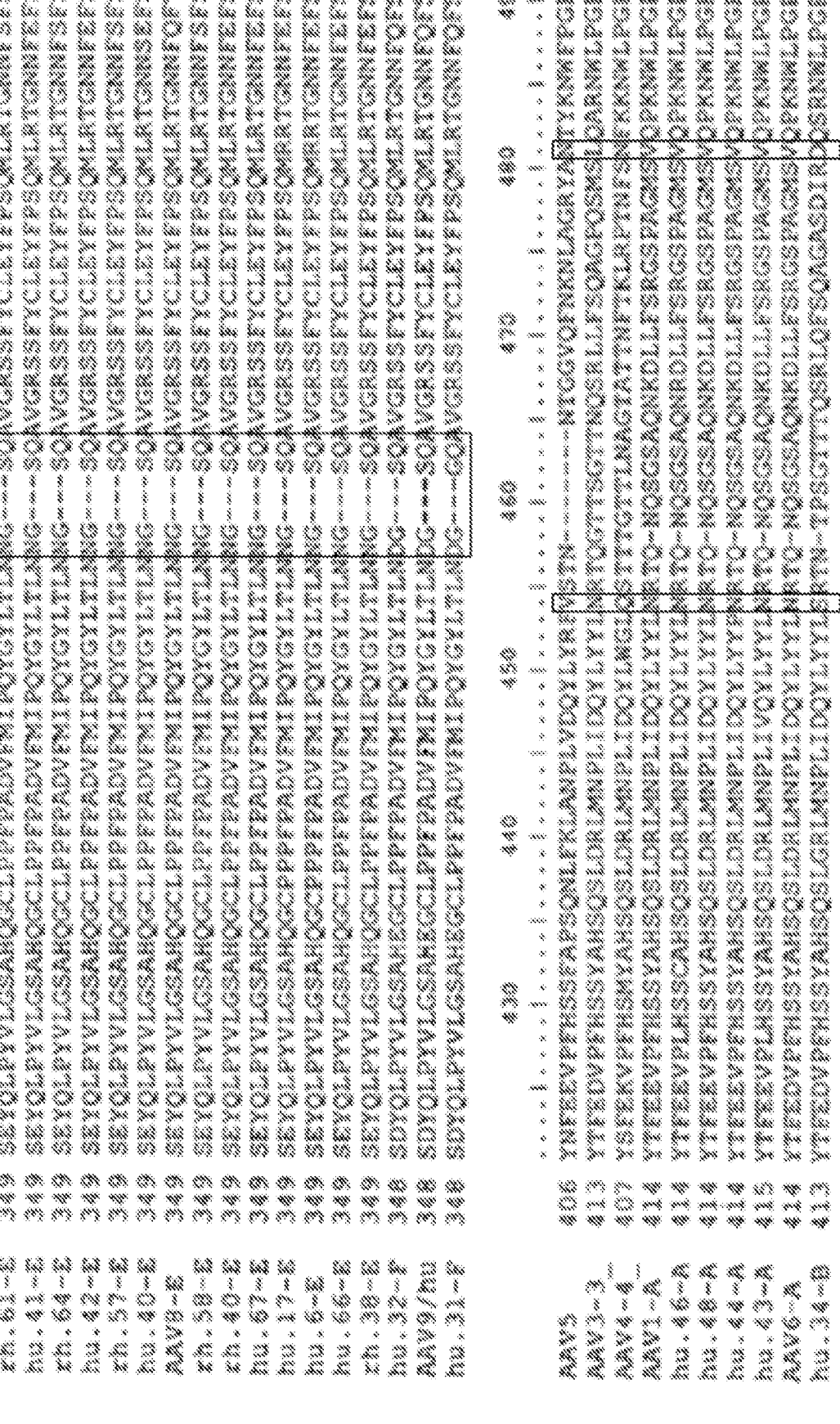
Figures 8, 9, 10, 11, 12, 13, 14, 15, 16, 17, 18:
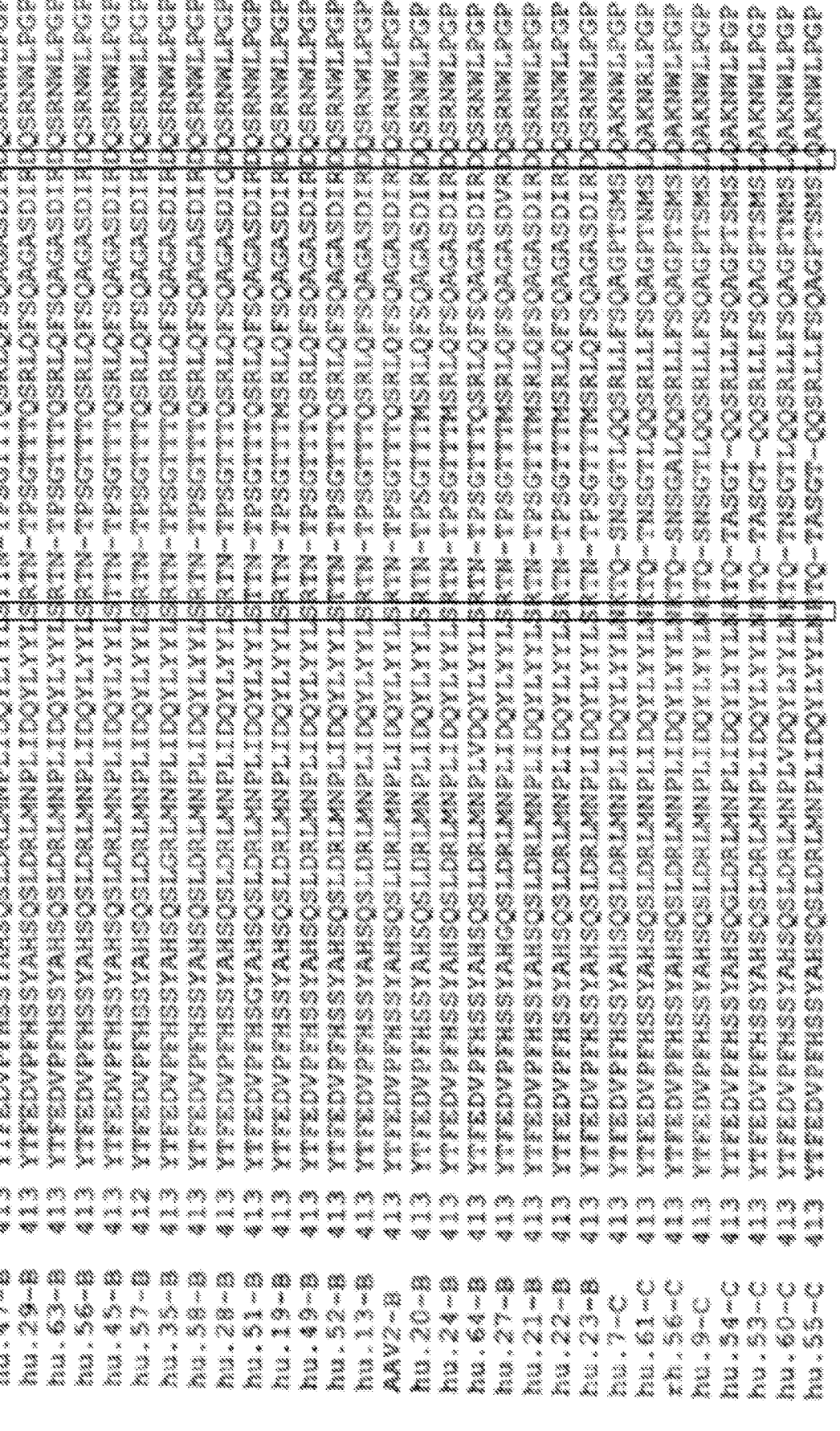
Figures 8, 9, 10, 11, 12, 13, 14, 15, 16, 17, 18, 19:
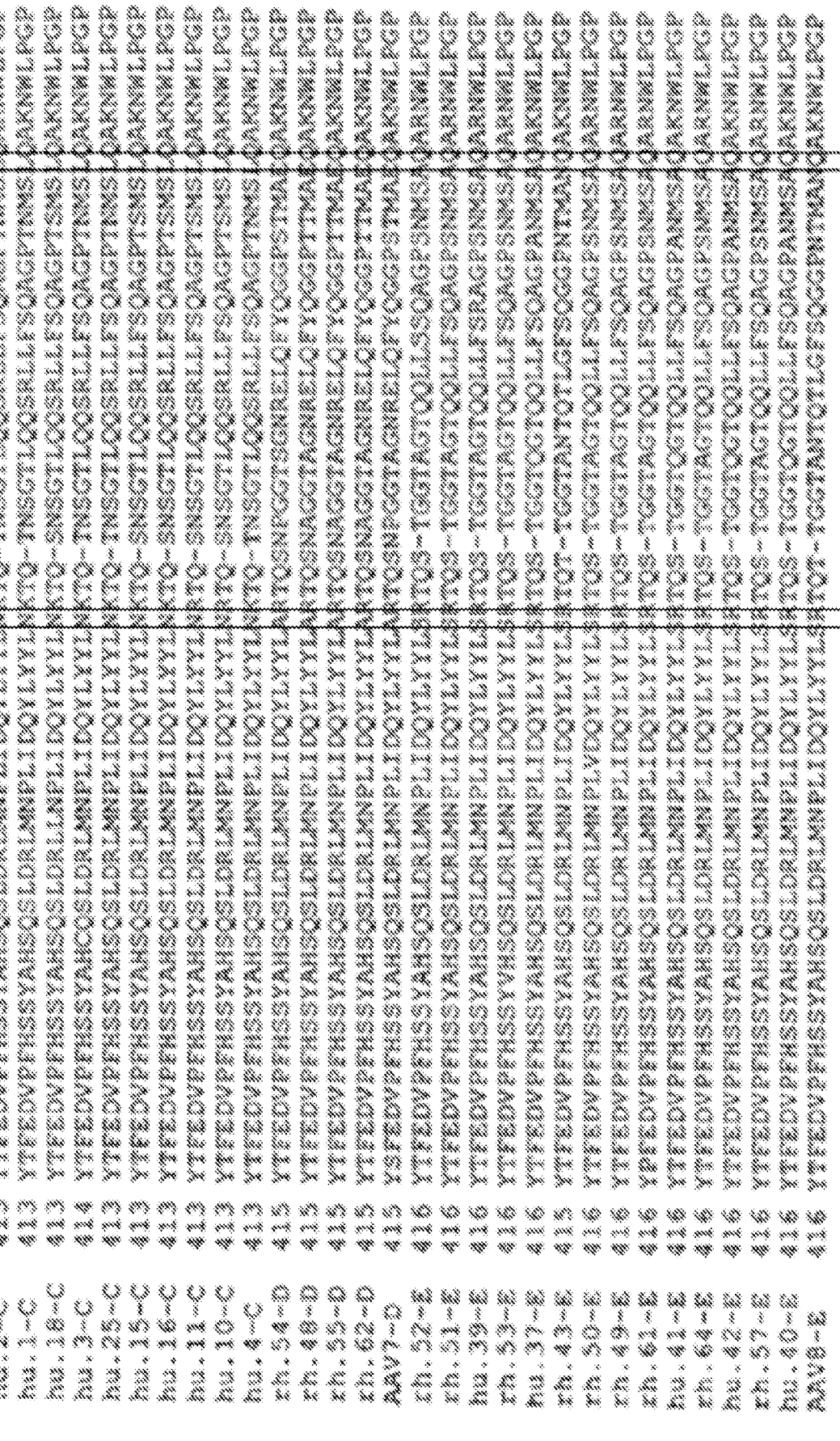
Figures 8, 9, 10, 11, 12, 13, 14, 15, 16, 17, 18, 19, 20:
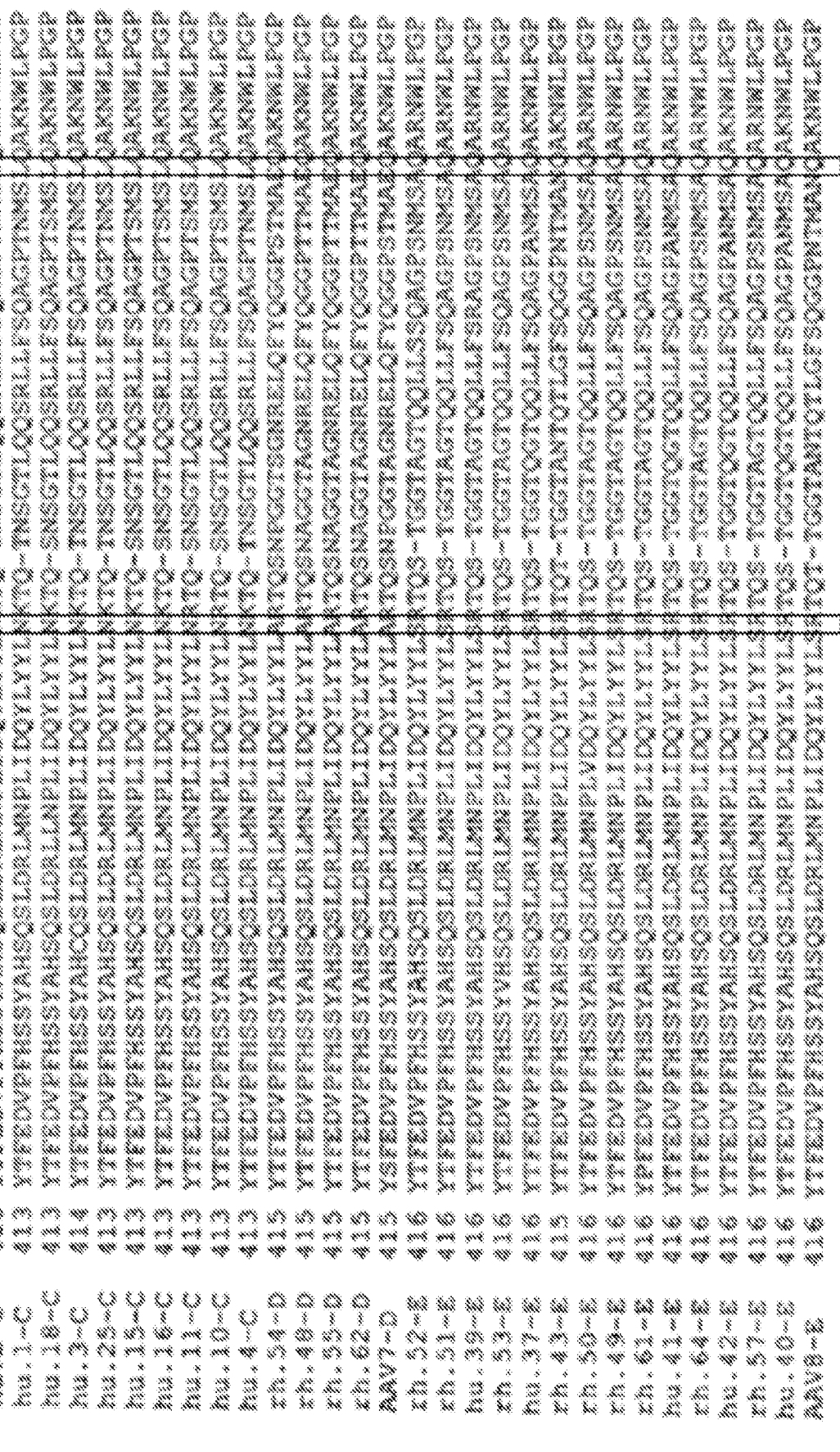
Figures 8, 9, 10, 11, 12, 13, 14, 15, 16, 17, 18, 19, 20, 21:
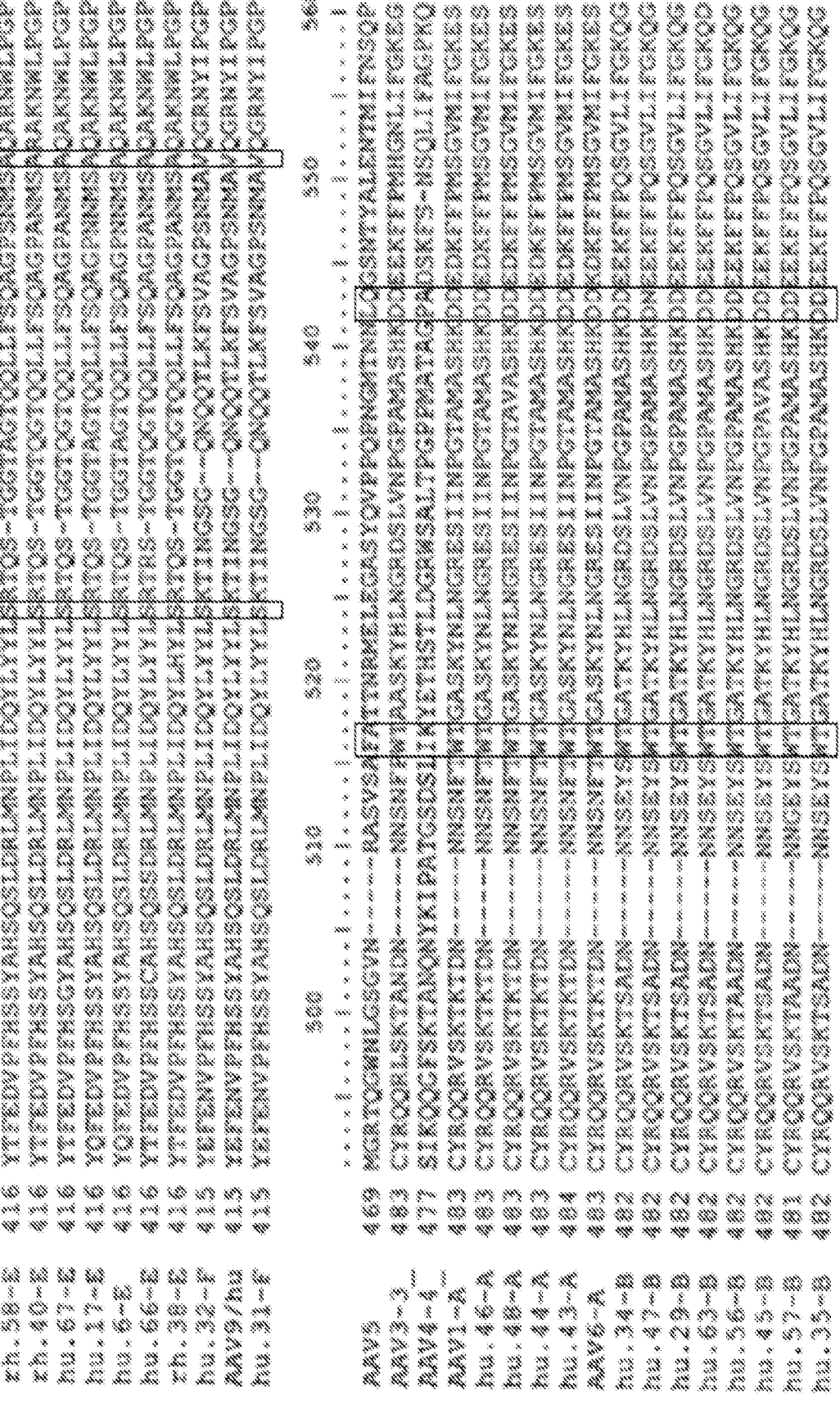
Figures 8, 9, 10, 11, 12, 13, 14, 15, 16, 17, 18, 19, 20, 21, 22:
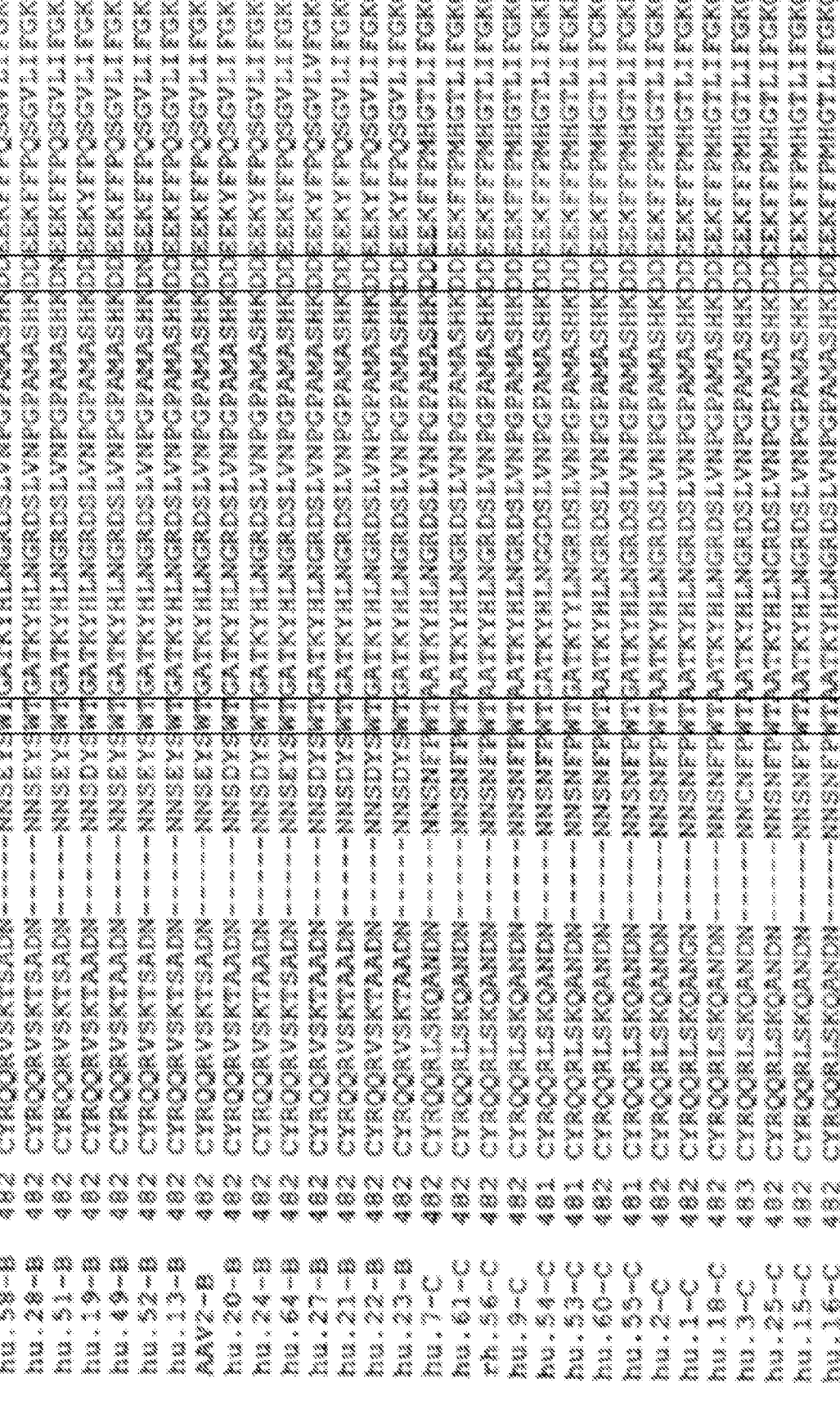
Figures 8, 9, 10, 11, 12, 13, 14, 15, 16, 17, 18, 19, 20, 21, 22, 23:
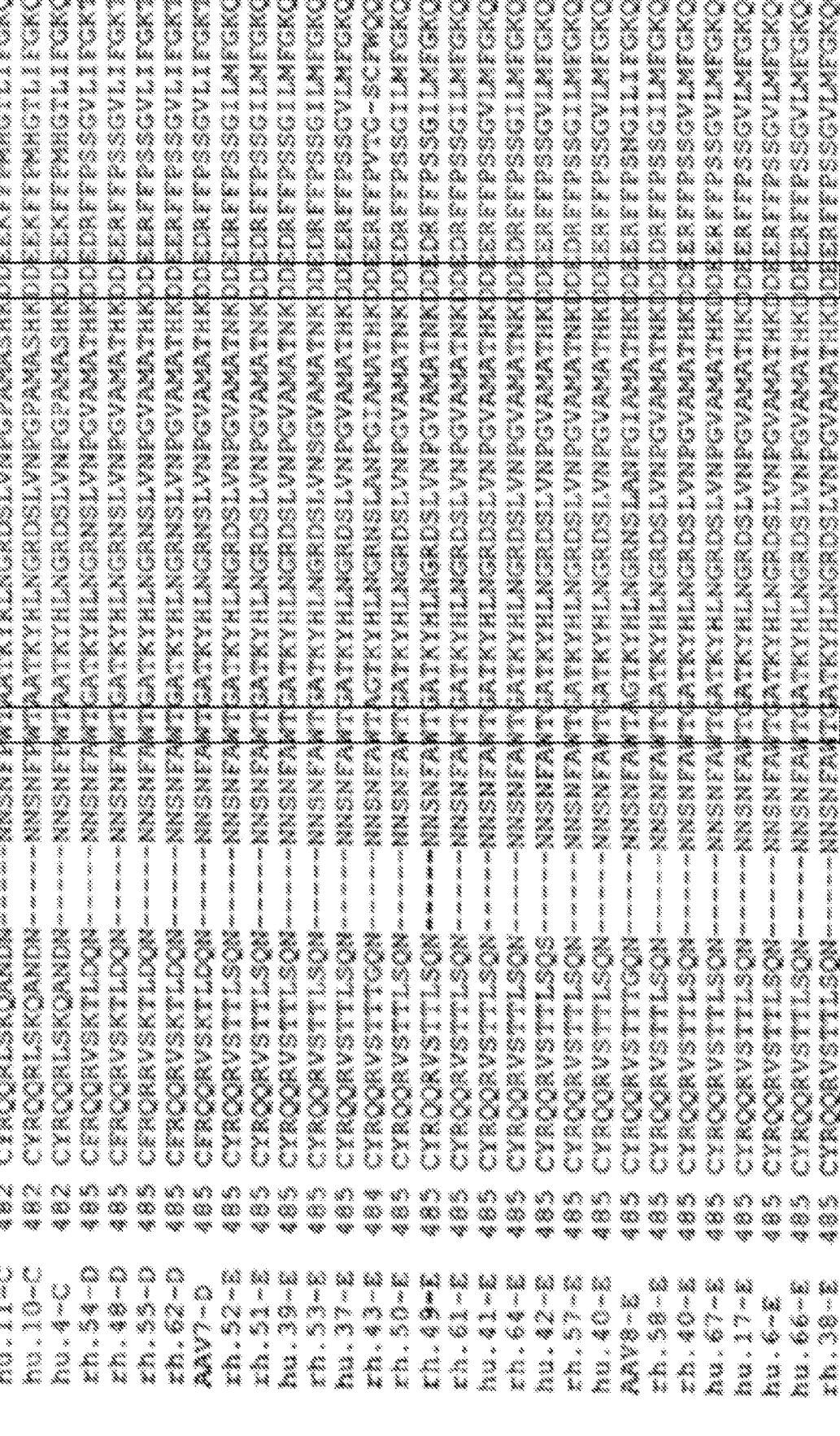
Figures 8, 9, 10, 11, 12, 13, 14, 15, 16, 17, 18, 19, 20, 21, 22, 23, 24, 25, 26, 27, 28, 29:
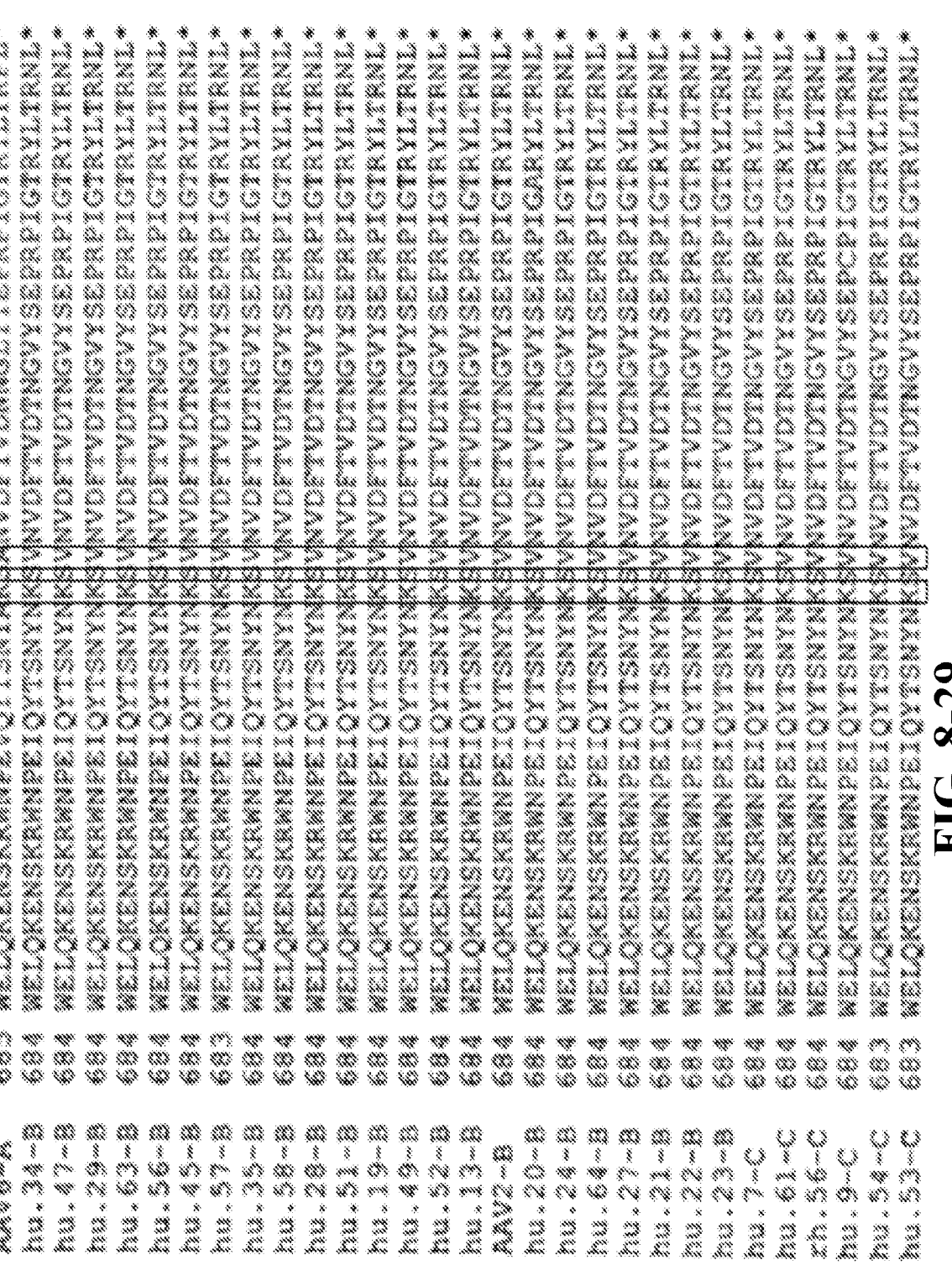
Figures 2, 9:
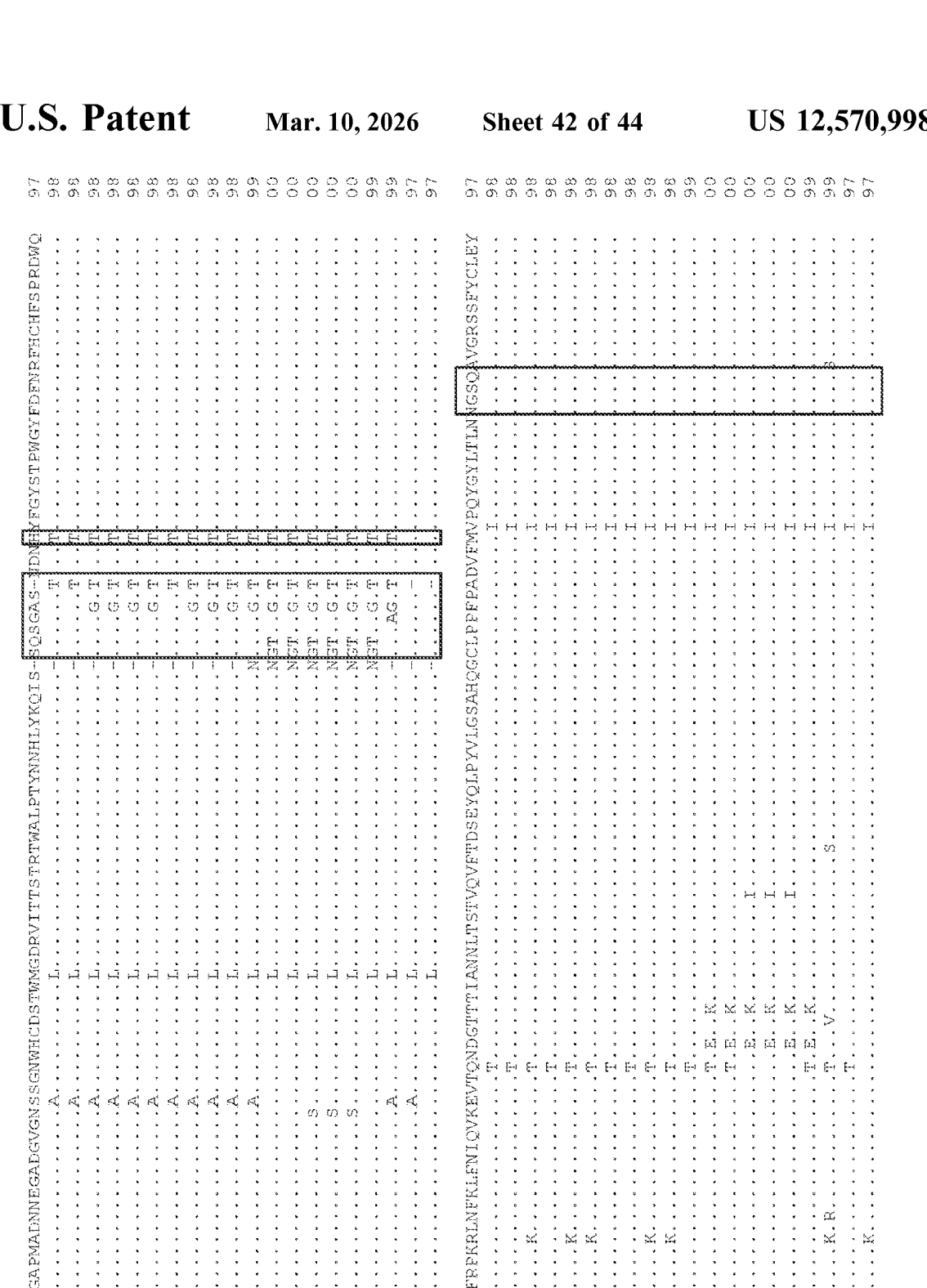
Figures 3, 9:
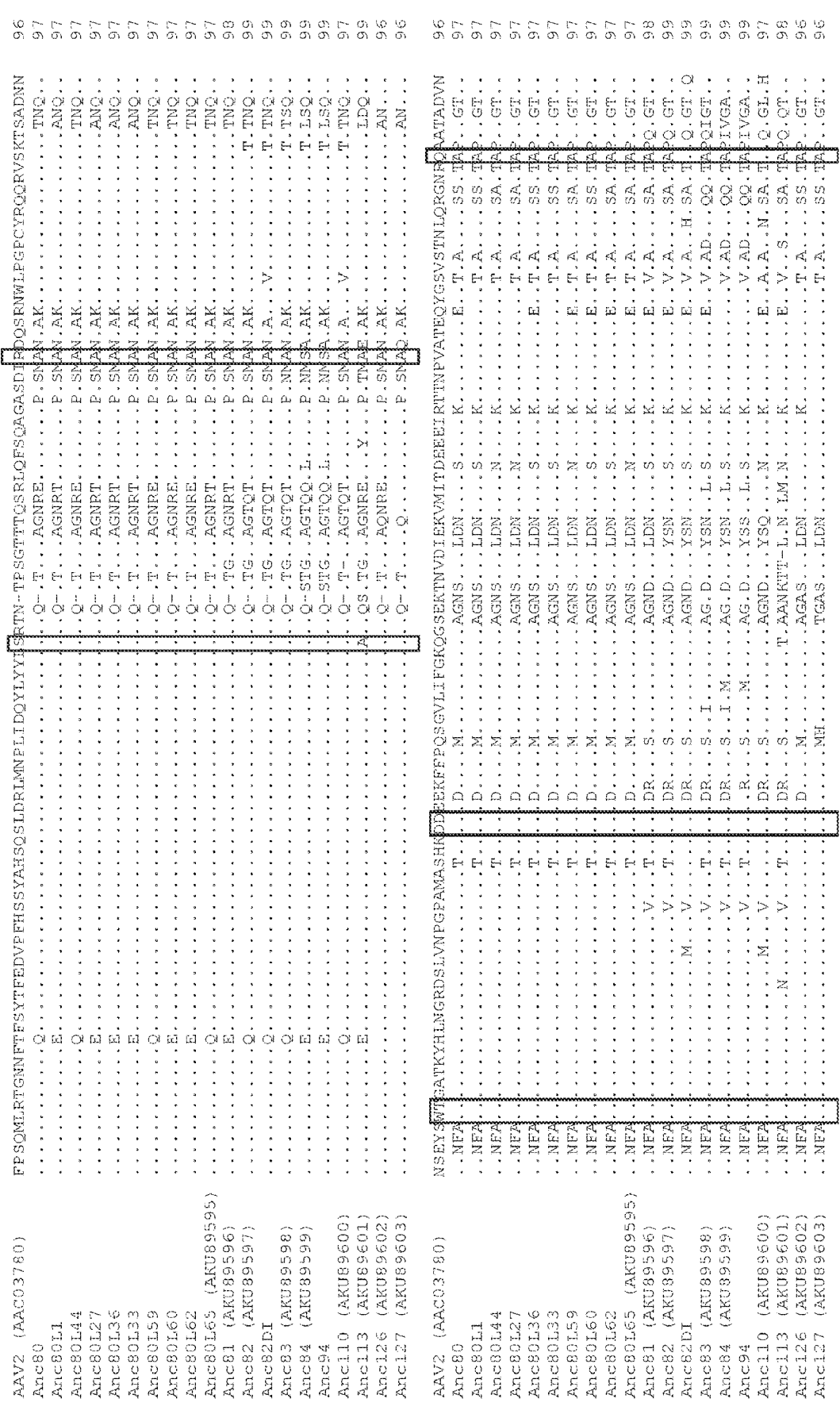
Figures 4, 9:
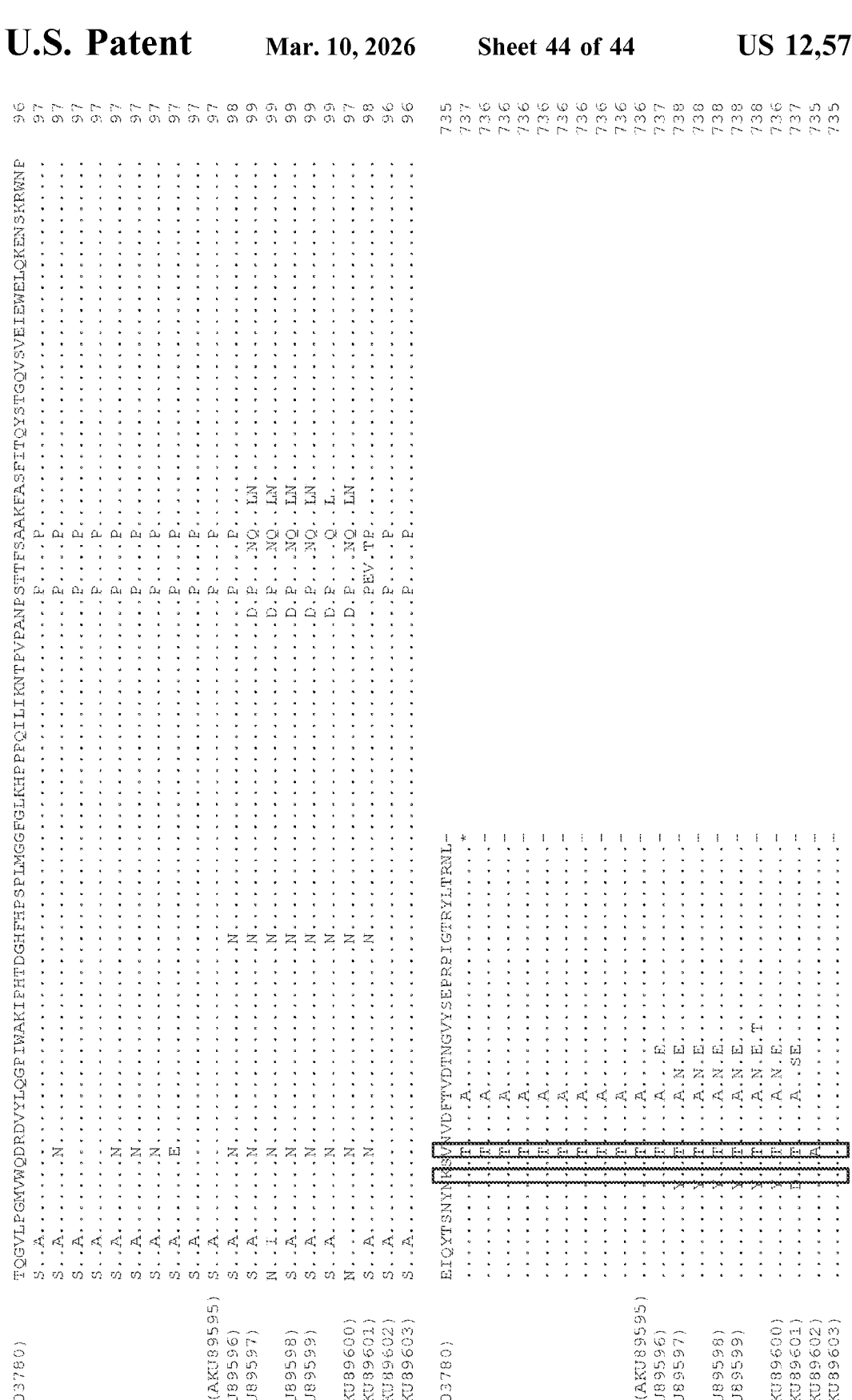

For example, the alignments shown in FIGS. 7 and 8 of VP1 capsid proteins from a number of different AAV serotypes, or a similarly produced alignment, sometimes referred to as a "pile-up," is one method that can be used to identify a position of an amino acid relative to, for example, AAV2 or any other unmodified AAV sequence.

The AAV-AAVR Interaction

It has previously been shown that the majority of AAV serotypes, except AAV4 and rh.32.33, require, and thus are dependent on, the AAV receptor (AAVR) for cellular transduction (Dudek et al., 2018, *J. Virol.*, 92(7) pii: e02213-17). The current disclosure describes the specific changes that can be made to the AAV capsid protein sequence to modulate the AAVR-AAV interaction by altering binding (e.g., affinity and/or avidity) to provide a modified "off" rate for this interaction. These specific changes to the AAV capsid protein sequence when used in vivo dramatically alter the liver uptake of "liver on" vectors versus "liver off" vectors, suggesting that reduced affinity AAVR-AAV interactions limit the binding and eventual uptake of liver toggle off vectors in the context of vectors circulating in blood and passing through the liver.

The data described herein further indicate that, in non-liver tissues, particularly those tissues compartmentalized from the vasculature (e.g., musculature), uptake and transduction of AAV is preserved, and, in certain embodiments, increases for vectors that are liver-de-targeted. While not wishing to be bound by theory, it is believed that this may be because in those non-liver tissues, the AAVR-AAV binding affinity is less impactful to transduction than in the absence of circulation, so the AAV resides in proximity to the tissue for a longer duration, reducing the influence of the binding kinetics on eventual tissue targeting. Again, while not wishing to be bound by theory, the increased level of transduction of liver de-targeted AAVs that is observed in certain non-liver tissues may additionally and/or alternatively be due to the increased bio-distribution, since less AAV would be depleted by liver uptake.

AAVR appears to be abundantly expressed in most tissues and those levels appear to be relatively similar across most tissues. Therefore, contrary to early predictions, the abundance of AAVR expression has not been directly predictive of AAV's tissue tropism. Instead, based on the data disclosed herein, AAV tissue tropism is influenced primarily by altered AAV sequence variants, including AAV sequence variants that retain dependence on AAVR. This further suggests that the structure of AAV can influence binding to AAVR and/or the engagement of cellular co-factors involved in binding to AAVR.

Methods of Modifying the Bio-Distribution of AAV

Changes can be introduced into an AAV nucleic acid molecule, leading to changes in the amino acid sequence of the encoded polypeptide(s). For example, changes can be introduced into nucleic acid coding sequences using mutagenesis (e.g., site-directed mutagenesis, PCR-mediated mutagenesis, CRISPR/Cas9 or other site-specific endonuclease-mediated mutagenesis) or by chemically synthesizing a nucleic acid molecule having such changes. Such nucleic acid changes can lead to conservative and/or non-conservative amino acid substitutions at one or more amino acid residues. A "conservative amino acid substitution" is one in which one amino acid residue is replaced with a different amino acid residue having a similar side chain (see, for example, Dayhoff et al. (1978, in Atlas of Protein Sequence and Structure, 5(Suppl. 3):345-352), which provides frequency tables for amino acid substitutions), and a non-conservative substitution is one in which an amino acid residue is replaced with an amino acid residue that does not have a similar side chain.

As described herein, positions Q263, S264, G265, A266, S267, N268, H271, N382, G383, S384, Q385, S446, R471, W502, T503, D528, D529, Q589, K706, or V708 in a capsid protein (numbered relative to the AAV2 VP1 capsid sequence (SEQ ID NO:1)) are involved in the binding to AAVR, and any one or more of those positions can be changed from their original amino acid, e.g., wild type or naturally occurring amino acid at that position, or the amino acid that is present at that position within a variant AAV, to modify (but not inhibit) binding between the modified AAV capsid protein and an AAV receptor (AAVR) on a liver cell in a manner that alters the AAV's ability to transduce a liver cell, thus altering the tropism or bio-distribution to the liver cells when the AAV is administered to a subject or patient and enters the circulation. Thus, changes are made in one or more of the residues at the indicated positions in a manner that results in an altered tropism of the modified (e.g., non-naturally occurring) AAV, but does not inhibit binding of the AAV to the AAVR of a given cell, which permits the liver de-targeted AAVs to bind to and transduce other types of cells in the body.

Specifically, at least positions 446, 471, and/or 708 within the VP1 capsid protein of AAV (numbered relative to the AAV2 VP1 capsid sequence (SEQ ID NO:1)) can be changed from their original, or wild type, sequence. As demonstrated in the Examples below, bio-distribution to the liver cells can be increased when the AAV capsid contains an R at position 446, an A at position 471, and/or a T at position 708, whereas bio-distribution to the liver cells can be decreased when the AAV capsid contains an S at position 446, an S at position 471, and/or an A at position 708 (all numbered relative to AAV2 (SEQ ID NO:1)). In some embodiments, a VP1 protein contains one or more of the following changes: S446N, S446R, R471A, R471S, V708T, or V708A (numbered relative to the AAV2 capsid sequence (SEQ ID NO:1)).

Specifically, at least positions 446, 471, and/or 708 within the VP1 capsid protein of AAV (numbered relative to the AAV2 VP1 capsid sequence (SEQ ID NO:1)) can be changed from their original, or wild type, sequence. As demonstrated in the Examples below, bio-distribution to the liver cells can be increased when the AAV capsid contains an R at position 446, an A at position 471, and/or a T at position 708, whereas bio-distribution to the liver cells can be decreased when the AAV capsid contains an S at position 446, an S at position 471, and/or an A at position 708 (all numbered relative to AAV2 (SEQ ID NO:1)). In some embodiments, a VP1 protein contains one or more of the following changes: S446N, S446R, R471A, R471S, V708T, or V708A (numbered relative to the AAV2 capsid sequence (SEQ ID NO:1)).

Specifically, at least positions 266, 271, and/or 446 within the VP1 capsid protein of AAV (numbered relative to the AAV2 VP1 capsid sequence (SEQ ID NO:1)) can be changed from their original, or wild type, sequence. Bio-distribution to the liver cells can be altered when the AAV capsid contains, for example, an A or a G at position 266, an H or T at position 271, and/or a S, N or R at position 446 (all numbered relative to AAV2 (SEQ ID NO:1)). In some embodiments, a VP1 protein contains one or more of the following changes: A266G, H271T, R446A, or R446S (numbered relative to the AAV2 capsid sequence (SEQ ID NO:1)).

Specifically, at least positions 471, 589, and/or 708 within the VP1 capsid protein of AAV (numbered relative to the AAV2 VP1 capsid sequence (SEQ ID NO:1)) can be changed from their original, or wild type, sequence. Bio-distribution to the liver cells can be altered when the AAV capsid contains, for example, an R, A or S at position 471, a Q or an A at position 589, and/or a V, T or A at position 708 (all numbered relative to AAV2 (SEQ ID NO:1)). In some embodiments, a VP1 protein contains one or more of the following changes: R471A, R471S, Q589A, V708T, or V708A (numbered relative to the AAV2 capsid sequence (SEQ ID NO:1)).

Specifically, at least positions 266, 446, and/or 589 within the VP1 capsid protein of AAV (numbered relative to the AAV2 VP1 capsid sequence (SEQ ID NO:1)) can be changed from their original, or wild type, sequence. As demonstrated in the Examples below, bio-distribution to the liver cells can be altered when the AAV capsid contains an A or a G at position 266, a S, N or R at position 446, and/or a Q or A at position 589 (all numbered relative to AAV2 (SEQ ID NO:1)). In some embodiments, a VP1 protein contains one or more of the following changes: A266G, S446N, S446R, or Q589R (numbered relative to the AAV2 capsid sequence (SEQ ID NO:1)).

Specifically, at least positions 271, 446, and/or 471 within the VP1 capsid protein of AAV (numbered relative to the AAV2 VP1 capsid sequence (SEQ ID NO:1)) can be changed from their original, or wild type, sequence. Bio-distribution to the liver cells can be altered when the AAV capsid contains an H or a T at position 271, an S, N or R at position 446, and/or an R, A or S at position 471 (all numbered relative to AAV2 (SEQ ID NO:1)). In some embodiments, a VP1 protein contains one or more of the following changes: H271T, S446N, S446R, R471A or R471S (numbered relative to the AAV2 capsid sequence (SEQ ID NO:1)).

Nucleic acids can be obtained or produced using any number of methods including, without limitation, chemical synthesis, recombinant nucleic acid technology, and/or the polymerase chain reaction (PCR). General PCR techniques are described, for example in PCR Primer: A Laboratory Manual (Dieffenbach & Dveksler, Eds., Cold Spring Harbor Laboratory Press, 1995), and recombinant nucleic acid techniques include, for example, restriction enzyme digestion and ligation. See, for example, Sambrook et al. (1989, Molecular Cloning; a laboratory manual, Cold Spring Harbor Laboratory Press, Cold Spring Harbor, NY).

Vectors containing nucleic acid molecules that encode polypeptides also are provided. Vectors, including expression vectors, are commercially available or can be produced by recombinant technology. A vector containing a nucleic acid molecule can have one or more elements for expression operably linked to such a nucleic acid molecule, and further can include sequences such as those encoding a selectable marker (e.g., an antibiotic resistance gene), and/or those that can be used in purification of a polypeptide (e.g., 6×His tag). Elements for expression include nucleic acid sequences that direct and regulate expression of nucleic acid coding sequences. One example of an expression element is a promoter sequence (e.g., CMV or other suitable viral promoters such as, without limitation, p5, p19, and p40). Expression elements also can include one or more of introns, enhancer sequences, response elements, or inducible elements that modulate expression of a nucleic acid molecule. Expression elements can be of bacterial, yeast, insect, mammalian, or viral origin and vectors can contain a combination of expression elements from different origins. As used herein, operably linked means that elements for expression are positioned in a vector relative to a coding sequence in such a way as to direct or regulate expression of the coding sequence.

A nucleic acid molecule, e.g., a nucleic acid molecule in a vector (e.g., an expression vector or a viral vector) can be introduced into a host cell. The term "host cell" refers not only to the particular cell(s) into which the nucleic acid molecule has been introduced, but also to the progeny or potential progeny of such a cell. Many suitable host cells are known to those skilled in the art; host cells can be prokaryotic cells (e.g., E. coli) or eukaryotic cells (e.g., yeast cells, insect cells, plant cells, mammalian cells). Representative host cells can include, without limitation, A549, WEHI, 3T3, 10T1/2, BHK, MDCK, COS 1, COS 7, BSC 1, BSC 40, BMT 10, VERO, WI38, HeLa, 293 cells, Saos, C2C12, L cells, HT1080, HepG2 and primary fibroblast, hepatocyte, and myoblast cells derived from mammals including human, monkey, mouse, rat, rabbit, and hamster. Methods for introducing nucleic acid molecules into host cells are well known in the art and include, without limitation, calcium phosphate precipitation, electroporation, heat shock, lipofection, microinjection, and viral-mediated nucleic acid transfer (e.g., transduction).

Toggle Sites

The present disclosure provides specific residues of AAV capsid proteins that can be modified to change targeting in vivo when rAAV is administered to a mammalian subject. Modification of the specific residues can alter transduction of target cells and/or transgene expression in target cells. The specific residues are referred to as toggle sites.

The toggle sites comprise amino acid residues involved in interactions between AAV capsid protein and AAVR, specifically at Q263, S264, G265, A266, S267, N268, H271, N382, G383, S384, Q385, S446, R471, W502, T503, D528, D529, Q589, K706, and V708, wherein the amino acid position is numbered relative to SEQ ID NO: 1 (AAV2 VP1). FIGS. 7-1 to 7-3, FIGS. 8-1 to 8-31 and FIGS. 9-1 to 9-4 show the respective toggle sites highlighted on the amino acid sequence of various unmodified AAV VP1 capsid proteins.

Target-specific tropism of AAVs can be altered by changing one or more amino acids at the toggle sites. A modified capsid protein (e.g., modified VP1 capsid) provided herein includes one or more amino acid difference in the toggle sites—Q263, S264, G265, A266, S267, N268, H271, N382, G383, S384, Q385, S446, R471, W502, T503, D528, D529, Q589, K706, and V708—compared to an unmodified capsid protein.

In some embodiments, the modification is introduced at selected toggle sites consisting of S446, R471 and V708. In some embodiments, the modification is not at A266.

Modification of the toggle sites can alter biodistribution of the modified rAAV. In some embodiments, the modification increases transduction of target cells compared to an unmodified rAAV. In some embodiments, the modification increases expression of an expressible polynucleotide delivered by the modified rAAV compared to an unmodified rAAV in target cells. In some embodiments, the modification decreases transduction of target cells compared to an unmodified rAAV. In some embodiments, the modification decreases expression of an expressible polynucleotide delivered by the modified rAAV compared to an unmodified rAAV in target cells. In some embodiments, the target is liver and the target cells are hepatocytes. In some embodiments, the target is not liver.

Modified AAV Capsid Protein

Modified capsid proteins of the present disclosure comprise means for altering rAAV biodistribution following administration to a mammalian subject as compared to biodistribution of an unmodified rAAV comprising VP1, VP2, and VP3 capsid proteins having amino acid sequences identical to those of the modified rAAV except for said means. rAAVs comprising the modified capsid proteins are referred to as modified rAAVs.

The means can alter the biodistribution when administered locally or systemically. In some embodiments, the means alter biodistribution when intravenously infused.

In some embodiments, the means for altering rAAV biodistribution change interaction of the modified rAAV with AAVR expressed on the mammalian subject's cells. For example, the means for altering rAAV biodistribution reduce or increase interaction of the modified rAAV with AAVR. In some embodiments, the means change binding affinity or binding stability between the modified AAV capsid protein and AAVR compared to an unmodified AAV capsid protein and AAVR. In some embodiments, the means comprise changes in the interaction interface between AAV capsid protein (VP1, VP2, or VP3 capsid protein) and AAVR.

In some embodiments, the means for altering rAAV biodistribution comprise a presence or absence of certain amino acid residues at one or more positions selected from the group consisting of Q263, S264, G265, A266, S267, N268, H271, N382, G383, S384, Q385, S446, R471, W502, T503, D528, D529, Q589, K706, and V708, wherein the amino acid position is numbered relative to SEQ ID NO: 1

(AAV2 VP1). In some embodiments, more than one amino acids can be substituted, inserted, and/or deleted at one or more positions selected from the group consisting of Q263, S264, G265, A266, S267, N268, H271, N382, G383, S384, Q385, S446, R471, W502, T503, D528, D529, Q589, K706, and V708 to introduce the means for altering rAAV biodistribution.

In some embodiments, the means for altering rAAV biodistribution comprises one or more amino acid substitution, insertion and/or deletion at one or more of the toggle sites—Q263, S264, G265, A266, S267, N268, H271, N382, G383, S384, Q385, S446, R471, W502, T503, D528, D529, Q589, K706, and V708. The amino acid substitution, insertion and/or deletion can change one or more original amino acid residues at a toggle site to one or more different amino acid residues that occur at the same toggle site of a different AAV capsid as provided in Tables 1A, 1B, 1C and 2. For example, the Q263 toggle site (relative to AAV2) can be changed from Q to any of A, E, T or G. The Q264 toggle site of AAV1 can be changed from S to any of G, T, A or V. Toggle sites where one or more amino acid substitution, insertion and/or deletion can be introduced are highlighted with boxes in FIGS. 7-1 to 7-3 and FIGS. 8-1 to 8-31.

In some embodiments, a modified VP1 capsid protein has a sequence shown in SEQ ID NO: 112-137. In some embodiments, a modified VP1 capsid protein has a sequence having at least 95%, 96%, 97%, 98%, 99%, or 95.5% identity to one of the sequences shown in SEQ ID NO: 112-137.

In some embodiments, a modified VP1 capsid protein has one of the sequences shown in SEQ ID NO: 1-100 with one or more amino acid substitutions, insertions, and/or deletions at one of the toggle sites—Q263, S264, G265, A266, S267, N268, H271, N382, G383, S384, Q385, S446, R471, W502, T503, D528, D529, Q589, K706, and V708, wherein the amino acid position is numbered relative to SEQ ID NO: 1 (AAV2 VP1). In some embodiments, a modified VP1 capsid protein has one of the sequences shown in SEQ ID NO: 1-100 with one or more amino acid substitutions, insertions, and/or deletions at one of the selected toggle sites—S446, R471 and V708, wherein the amino acid position is numbered relative to SEQ ID NO: 1 (AAV2 VP1).

TABLE 1A

| Position | AAV2 | AAV1 | AAV6 | AAV3 | AAVLK03 | AAV7 | AAV8 | AAVhu.37 | AAVrh.10 | AAV9 | AAVhu.68 | AAV10 | AAV5 |
|---|---|---|---|---|---|---|---|---|---|---|---|---|---|
| 263 | Q | A | A | Q | Q | E | T | T | T | T | T | T | G |
| 264 | S | S | S | S | S | T | S | S | S | S | S | S | S |
| 265 | G | T | T | G | G | A | G | G | G | G | G | G | V |
| 266 | A | G | G | A | A | G | G | G | G | G | G | G | D |
| 267 | S | S | S | S | S | T | T | T | T | S | S | T | S |
| 268 | N | N | N | N | N | N | N | N | N | N | N | N | N |
| 271 | H | H | H | H | H | T | T | T | T | A | A | T | A |
| 382 | N | N | N | N | N | N | N | N | N | D | D | N | N |
| 383 | G | G | G | G | G | G | G | G | G | G | G | G | T |
| 384 | S | S | S | S | S | S | S | S | S | S | S | S | E |
| 385 | Q | Q | Q | Q | Q | Q | Q | Q | Q | Q | Q | Q | N |
| 446 | S | N | N | N | N | A | S | S | S | S | S | S | V |
| 471 | R | S | S | S | S | A | A | S | S | A | A | S | A |
| 502 | W | W | W | W | W | W | W | W | W | W | W | W | F |
| 503 | T | T | T | T | T | T | T | T | T | P | P | T | A |
| 528 | D | D | D | D | D | D | D | D | D | E | E | D | L |
| 529 | D | D | D | D | D | D | D | D | D | G | G | D | Q |
| 589 | Q | D | D | A | A | A | A | G | A | Q | Q | G | A |
| 706 | K | K | K | K | K | K | K | K | K | K | K | K | D |
| 708 | V | A | A | V | V | T | T | T | T | N | N | T | Q |

TABLE 1B

| Position | AAV2 | Anc80 | Anc81 | Anc82 | Anc83 | Anc84 | Anc94 | Anc110 | Anc113 | Anc126 | Anc127 |
|---|---|---|---|---|---|---|---|---|---|---|---|
| 263 | Q | Q | Q | T | T | T | T | T | Q | Q | Q |
| 264 | S | S | S | S | S | S | S | S | S | S | S |
| 265 | G | G | G | G | G | G | G | G | A | G | G |
| 266 | A | A | G | G | G | G | G | G | G | A | A |
| 267 | S | S | T | T | T | T | T | T | T | S | S |
| 268 | N | N | N | N | N | N | N | N | N | N | N |
| 271 | H | T | T | T | T | T | T | T | T | H | H |
| 382 | N | N | N | N | N | N | N | N | N | N | N |
| 383 | G | G | G | G | G | G | G | G | G | G | G |
| 384 | S | S | S | S | S | S | S | S | S | S | S |
| 385 | Q | Q | Q | Q | Q | Q | Q | Q | Q | Q | Q |
| 446 | S | S | S | S | S | S | S | S | A | S | S |
| 471 | R | A | A | A | A | S | S | A | A | A | A |
| 502 | W | W | W | W | W | W | W | W | W | W | W |
| 503 | T | T | T | T | T | T | T | T | T | T | T |
| 528 | D | D | D | D | D | D | D | D | D | D | D |
| 529 | D | D | D | D | D | D | D | D | D | D | D |
| 589 | Q | A | A | A | A | A | A | Q | A | A | A |
| 706 | K | K | K | K | K | K | K | K | K | K | K |
| 708 | V | T | T | T | T | T | T | T | T | A | V |

TABLE 1C

| Position | AAV2 | Anc80L27 | Anc80L59 | Anc80L60 | Anc80L62 | Anc80L65 | Anc80L33 | Anc80L36 | Anc80L44 | Anc80L1 |
|---|---|---|---|---|---|---|---|---|---|---|
| 263 | Q | Q | Q | Q | Q | Q | Q | Q | Q | Q |
| 264 | S | S | S | S | S | S | S | S | S | S |
| 265 | G | G | G | G | G | G | G | G | G | G |
| 266 | A | G | A | G | G | G | G | G | G | A |
| 267 | S | T | T | T | T | T | T | T | T | T |
| 268 | N | N | N | N | N | N | N | N | N | N |
| 271 | H | T | T | T | T | T | T | T | T | T |
| 382 | N | N | N | N | N | N | N | N | N | N |
| 383 | G | G | G | G | G | G | G | G | G | G |
| 384 | S | S | S | S | S | S | S | S | S | S |
| 385 | Q | Q | Q | Q | Q | Q | Q | Q | Q | Q |
| 446 | S | S | S | S | S | S | S | S | S | S |
| 471 | R | A | A | A | A | A | A | A | A | A |
| 502 | W | W | W | W | W | W | W | W | W | W |
| 503 | T | T | T | T | T | T | T | T | T | T |
| 528 | D | D | D | D | D | D | D | D | D | D |
| 529 | D | D | D | D | D | D | D | D | D | D |
| 589 | Q | A | A | A | A | A | A | A | A | A |
| 706 | K | K | K | K | K | K | K | K | K | K |
| 708 | V | T | T | T | T | T | T | T | T | T |

In some embodiments the means for altering rAAV bio-distribution comprises one or more amino acid substitutions, insertions, and/or deletions at more than one of the toggle sites. In some embodiments the means for altering rAAV biodistribution comprises one or more amino acid substitution, insertion, and/or deletion at two of the toggle sites. In some embodiments the means for altering rAAV biodistribution comprises one or more amino acid substitution, insertion, and/or deletion at three of the toggle sites. In some embodiments the means for altering rAAV biodistribution comprises one or more amino acid substitution, insertion, and/or deletion at four, five, six, seven, eight, nine, ten, eleven, twelve, thirteen, fourteen, fifteen, sixteen, seventeen, eighteen, nineteen or twenty of the toggle sites. In some embodiments, the means for altering rAAV biodistribution comprises one or more amino acid substitution, insertion, and/or deletion at A2666 and one or more additional amino acid substitutions, insertion and/or deletion at other toggle sites—Q263, S264, G265, S267, N268, H271, N382, G383, S384, Q385, S446, R471, W502, T503, D528, D529, Q589, K706, and V708. In some embodiments, the means for altering rAAV biodistribution does not comprise an amino acid substitution at A266.

In some embodiments, the means for altering rAAV biodistribution comprises one or more amino acid substitutions at the selected toggle sites—S446, R471 and V708. In some embodiments, the means for altering rAAV biodistribution comprises two amino acid substitutions or three amino acid substitutions at the selected toggle sites. In some embodiments, the modified VP1 capsid protein comprises one, two or three amino acid residues selected from the group consisting of 446R, 471A and 708T. In some embodiments, the modified VP1 capsid protein comprises one, two or three amino acid residues selected from the group consisting of 446S, 471S and 708A.

In some embodiments, a modified AAV capsid protein differs from the unmodified AAV capsid protein having greatest sequence identity to the modified AAV capsid protein VP1 protein, as aligned using default parameters. In some embodiments, a modified AAV capsid protein differs from the unmodified AAV capsid protein with greatest sequence identity only at the toggle sites, Q263, S264, G265, A266, S267, N268, H271, N382, G383, S384, Q385, S446, R471, W502, T503, D528, D529, Q589, K706, and V708, wherein the amino acid position is numbered relative to SEQ ID NO: 1 (AAV2 VP1). In some embodiments, a modified AAV capsid protein differs from the unmodified AAV capsid protein with greatest sequence identity only at the selected toggle sites, S446, R471 and V708, wherein the amino acid position is numbered relative to SEQ ID NO: 1 (AAV2 VP1).

In some embodiments, a modified AAV capsid protein differs from the unmodified rAAV capsid protein with greatest sequence identity at the toggle sites as well as outside of the toggle sites. In some embodiments, a modified AAV capsid protein has 95%, 96%, 97%, 98%, 99% or 99.5% sequence identity to the unmodified AAV capsid protein with greatest sequence identity.

In one aspect, the present disclosure provides a modified polynucleotide encoding a modified AAV capsid protein. The modified polynucleotide encoding a modified AAV capsid protein can have one or more nucleotide substitution, insertion or deletion at one or more positions selected from the group consisting of (787-789), (790-792), (793-795), (796-798), (799-801), (802-804), (811-813), (1144-1146), (1150-1152), (1153-1155), (1336-1338), (1411-1413), (1504-1506), (1507-1509), (1582-1584), (1585-1587), (1765-1767), (2116-2118), or (2122-2124) compared to an unmodified polynucleotide encoding an unmodified AAV capsid, wherein the nucleotide position is numbered relative to SEQ ID NO: 141 (AAV2 VP1). The nucleotide substitution, insertion or deletion can introduce one or more amino acid substitution, insertion and/or deletion at one or more of the toggle sites—Q263, S264, G265, A266, S267, N268, H271, N382, G383, S384, Q385, S446, R471, W502, T503, D528, D529, Q589, K706, and V708 to the capsid protein encoded by the polynucleotide.

In some embodiments, the modified polynucleotide comprises one of the sequences shown in SEQ ID NO: 136-141 with one or more nucleotide substitution, insertion or deletion at one or more positions selected from the group consisting of (787-789), (790-792), (793-795), (796-798), (799-801), (802-804), (811-813), (1144-1146), (1150-1152), (1153-1155), (1336-1338), (1411-1413), (1504-1506), (1507-1509), (1582-1584), (1585-1587), (1765-1767), (2116-2118), or (2122-2124), wherein the nucleotide position is numbered relative to SEQ ID NO: 141 (AAV2 VP1).

In one aspect, the present disclosure provides a modified polynucleotide encoding a modified AAV capsid protein. The modified polynucleotide encoding a modified AAV capsid protein can have one or more nucleotide substitution, insertion or deletion at one or more positions selected from the group consisting of (1336-1338), (1411-1413) or (2122-2124) compared to an unmodified polynucleotide encoding an unmodified AAV capsid, wherein the nucleotide position is numbered relative to SEQ ID NO: 141 (AAV2 VP1). The nucleotide substitution, insertion or deletion can introduce one or more amino acid substitution, insertion and/or deletion at one or more of the selected toggle sites—S446, R471 and V708 to the capsid protein encoded by the polynucleotide. The nucleotide substitution, insertion or deletion can introduce one or more amino acid substitution, insertion and/or deletion at one or more of the selected toggle sites—A266, S446, R471 and V708.

In some embodiments, the modified polynucleotide comprises one of the sequences shown in SEQ ID NO: 147-151 with one or more nucleotide substitution, insertion or deletion at one or more positions selected from the group consisting of (1336-1338), (1411-1413) or (2122-2124), wherein the nucleotide position is numbered relative to SEQ ID NO: 141 (AAV2 VP1).

In another aspect, the present disclosure provides a vector comprising the modified polynucleotide encoding a modified AAV capsid protein described herein. In some embodiments, the vector is a plasmid.

Modified Recombinant AAV (Modified rAAV)

The present disclosure further provides modified rAAVs comprising a modified AAV capsid protein (VP1, VP2 or VP3 capsid protein) disclosed herein and a recombinant nucleic acid vector.

In some embodiments, the modified rAAV achieves higher transduction of liver following administration to a mammalian subject as compared to an unmodified rAAV comprising an unmodified VP1 capsid protein having greatest sequence identity to the modified VP1 administered by the same route of administration. In some embodiments, the modified rAAV achieves higher expression in liver of an expressible polynucleotide within the recombinant nucleic acid genome following administration to a mammalian subject as compared to expression of the expressible polynucleotide administered in an unmodified rAAV comprising a VP1 capsid protein having greatest sequence identity to the modified VP1, administered by the same route of administration.

In some embodiments, the modified rAAV achieves lower transduction of liver following administration to a mammalian subject as compared to an unmodified rAAV comprising a VP1 capsid protein having greatest sequence identity to the modified VP1, administered by the same route of administration. In some embodiments, the modified rAAV achieves lower expression in liver of an expressible polynucleotide within the recombinant nucleic acid genome following administration to a mammalian subject as compared to the expressible polynucleotide administered in an unmodified rAAV comprising a VP1 capsid protein having greatest sequence identity to the modified VP1 administered by the same route of administration.

In some embodiments, the modified rAAV achieves higher transduction of an organ outside of liver following administration to a mammalian subject as compared to an unmodified rAAV comprising an unmodified VP1 capsid protein having greatest sequence identity to the modified VP1, administered by the same route of administration. In some embodiments, the modified rAAV achieves higher expression in an organ outside of liver of an expressible polynucleotide within the recombinant nucleic acid genome as compared to the expressible polynucleotide delivered in an unmodified rAAV comprising an unmodified VP1 capsid protein having greatest sequence identity to the modified VP1 administered by the same route of administration.

In some embodiments, the modified rAAV achieves lower transduction of an organ outside of liver of an expressible polynucleotide within the recombinant nucleic acid genome as compared to the expressible polynucleotide delivered in an unmodified rAAV comprising an unmodified VP1 capsid protein having greatest sequence identity to the modified VP1 administered by the same route of administration. In some embodiments, the modified rAAV achieves lower expression in an organ outside of liver of an expressible polynucleotide within the recombinant nucleic acid genome following administration to a mammalian subject as compared to the expressible polynucleotide administered in an unmodified rAAV comprising a VP1 capsid protein having greatest sequence identity to the modified VP1 administered by the same route of administration.

In some embodiments, the modified rAAV has reduced interaction with AAVR expressed on the mammalian subject's cells as compared to an unmodified rAAV comprising an unmodified VP1 capsid protein having greatest sequence identity to the modified VP1 administered by the same route of administration. In some embodiments, the modified rAAV has greater interaction with AAVR expressed on the mammalian subject's cells as compared to an unmodified rAAV comprising an unmodified VP1 capsid protein having greatest sequence identity to the modified VP1 delivered by the same route of administration.

In some embodiments, the modified rAAV has less liver toxicity than an unmodified rAAV comprising an unmodified VP1 capsid protein having greatest sequence identity to the modified VP1 administered by the same route of administration and in the same dose.

Pharmaceutical Composition Comprising Modified rAAV

In one aspect, the present disclosure provides a pharmaceutical composition comprising a modified rAAV of the present disclosure and a pharmaceutically acceptable carrier. The modified rAAV comprises a modified AAV capsid protein as described herein and a recombinant nucleic acid vector containing an expressible polynucleotide.

The pharmaceutical composition can be used to deliver the recombinant nucleic acid vector to a target within a mammalian subject. When the pharmaceutical composition is administered, the modified rAAV can achieve a higher transduction of target cells following administration to a mammalian subject as compared to an unmodified rAAV comprising an unmodified VP1 capsid protein having greatest sequence identity to the modified VP1 administered by the same route of administration and in the same dose. In some embodiments, the modified rAAV achieves higher expression in target cells of an expressible polynucleotide within the recombinant nucleic acid genome following administration to a mammalian subject as compared to the expressible polynucleotide administered in an unmodified rAAV comprising a VP1 capsid protein having greatest sequence identity to the modified VP1 administered by the same route of administration and in the same dose.

Targeting of modified rAAVs can be tested in an experimental animal by measuring rAAV transduction or expression of an expressible polynucleotide. In some embodiments, targeting is measured in a non-human primate (NHP), mice, rats, birds, rabbits, guinea pigs, hamsters, farm animals (including pigs and sheep), dogs, or cats.

Targeting of modified rAAVs can be measured after systemic or local administration of rAAVs. In some embodiments, targeting of modified rAAVs is measured after intravenous infusion of rAAVs.

In some embodiments, the modified rAAV achieves 2-fold, 3-fold, 4-fold, 5-fold, 10-fold, 20-fold, 30-fold, 40-fold, 50-fold, 100-fold, 200-fold, 500-fold, 750-fold, 1000-fold, or 2500-fold reduction in gene transfer to the liver or in viral infection or transgene expression in liver cells after a first administration into a mammalian subject compared to an unmodified rAAV. In some embodiments, the modified rAAV achieves 2-fold, 3-fold, 4-fold, 5-fold, 10-fold, 20-fold, 30-fold, 40-fold, 50-fold, 100-fold, 200-fold, 500-fold, 750-fold, 1000-fold, or 2500-fold reduction in gene transfer to the liver or in viral infection or transgene expression in liver cells after a first administration into a rhesus macaque.

In some embodiments, the modified rAAV achieves at least 10-fold increase in gene transfer to the liver or in viral infection or transgene expression in liver cells after a first administration into a mammalian subject compared to an unmodified rAAV. In some embodiments, the modified rAAV achieves at least 10-fold increase in gene transfer to the liver or in viral infection or transgene expression in liver cells after a first administration into a rhesus macaque.

In some embodiments, the modified rAAV achieves at least 10-fold reduction in gene transfer to the liver or in viral infection or transgene expression in liver cells after a first administration into a mammalian subject compared to an unmodified rAAV. In some embodiments, the modified rAAV achieves at least 10-fold reduction in gene transfer to the liver or in viral infection or transgene expression in liver cells after a first administration into a rhesus macaque.

In some embodiments, the modified rAAV achieves at least 10-fold increase in gene transfer to the liver or in viral infection or transgene expression in liver cells after a first administration into a mammalian subject compared to an unmodified rAAV. In some embodiments, the modified rAAV achieves at least 10-fold increase in gene transfer to the liver or in viral infection or transgene expression in liver cells after a first administration into a rhesus macaque.

In some embodiments, the modified rAAV achieves at least 100-fold reduction in gene transfer to the liver or in viral infection or transgene expression in liver cells after a first administration into a mammalian subject compared to an unmodified rAAV. In some embodiments, the modified rAAV achieves at least 100-fold reduction in gene transfer to the liver or in viral infection or transgene expression in liver cells after a first administration into a rhesus macaque.

In some embodiments, the modified rAAV achieves at least 100-fold increase in gene transfer to the liver or in viral infection or transgene expression in liver cells after a first administration into a mammalian subject compared to an unmodified rAAV. In some embodiments, the modified rAAV achieves at least 100-fold increase in gene transfer to the liver or in viral infection or transgene expression in liver cells after a first administration into a rhesus macaque.

In some embodiments, the modified rAAV achieves at least 1000-fold reduction in gene transfer to the liver or in viral infection or transgene expression in liver cells after a first administration into a mammalian subject compared to an unmodified rAAV. In some embodiments, the modified rAAV achieves at least 1000-fold reduction in gene transfer to the liver or in viral infection or transgene expression in liver cells after a first administration into a rhesus macaque.

In some embodiments, the modified rAAV achieves at least 1000-fold increase in gene transfer to the liver or in viral infection or transgene expression in liver cells after a first administration into a mammalian subject compared to an unmodified rAAV. In some embodiments, the modified rAAV achieves at least 1000-fold increase in gene transfer to the liver or in viral infection or transgene expression in liver cells after a first administration into a rhesus macaque.

Methods of Using Liver-Toggled Viruses

A non-naturally occurring, modified AAV virus as described herein (e.g., in which the VP1 capsid protein sequence is changed or engineered to exhibit the desired bio-distribution (e.g., liver-on or liver off)) can be used in a number of research and/or therapeutic applications. For example, a liver-on or liver-off virus can be used in human or animal medicine for gene therapy (e.g., in a vector or vector system for gene transfer) or for vaccination (e.g., for antigen presentation). More specifically, a liver-on or liver-off virus can be used for gene addition, gene augmentation, genetic delivery of a polypeptide therapeutic, genetic vaccination, gene silencing, genome editing, gene therapy, RNAi delivery, cDNA delivery, mRNA delivery, miRNA delivery, miRNA sponging, genetic immunization, optogenetic gene therapy, transgenesis, DNA vaccination, or DNA immunization of liver cells or non-liver cells.

A non-naturally occurring, modified AAV in which the sequence of the capsid protein has been changed to alter the bio-distribution of the AAV (e.g., the liver bio-distribution) can include a transgene (in cis or trans configuration with other viral sequences). A transgene can be, for example, a reporter gene (e.g., beta-lactamase, beta-galactosidase (LacZ), alkaline phosphatase, thymidine kinase, green fluorescent polypeptide (GFP), chloramphenicol acetyltransferase (CAT), or luciferase, or fusion polypeptides that include an antigen tag domain such as hemagglutinin or Myc), or a therapeutic gene (e.g., genes encoding hormones or receptors thereof, growth factors or receptors thereof, differentiation factors or receptors thereof, immune system regulators (e.g., cytokines and interleukins) or receptors thereof, enzymes, RNAs (e.g., inhibitory RNAs or catalytic RNAs), or target antigens (e.g., oncogenic antigens, autoimmune antigens)).

The particular transgene will be selected depending, at least in part, on the particular disease or deficiency being treated. Simply by way of example, gene transfer or gene therapy can be applied to the treatment of hemophilia, retinitis pigmentosa, cystic fibrosis, leber congenital amaurosis, lysosomal storage disorders, inborn errors of metabolism (e.g., inborn errors of amino acid metabolism including phenylketonuria, inborn errors of organic acid metabolism including propionic acidemia, inborn errors of fatty acid metabolism including medium-chain acyl-CoA dehydrogenase deficiency (MCAD)), cancer, achromatopsia, cone-rod dystrophies, macular degenerations (e.g., age-related macular degeneration), lipopolypeptide lipase deficiency, familial hypercholesterolemia, spinal muscular atrophy, Duchenne's muscular dystrophy, Alzheimer's disease, Parkinson's disease, obesity, inflammatory bowel disorder, diabetes, congestive heart failure, hypercholesterolemia, hearing loss, coronary heart disease, familial renal amyloidosis, Marfan's syndrome, fatal familial insomnia, Creutzfeldt-Jakob disease, sickle-cell disease, Huntington's disease, fronto-temporal lobar degeneration, Usher syndrome, lactose intolerance, lipid storage disorders (e.g., Niemann-Pick disease, type C), Batten disease, choroideremia, glycogen storage disease type II (Pompe disease), ataxia telangiectasia (Louis-Bar syndrome), congenital hypothyroidism, severe combined immunodeficiency (SCID), and/or amyotrophic lateral sclerosis (ALS). A transgene also can be, for example, an immunogen that is useful for immunizing a subject (e.g., a human, an animal (e.g., a companion animal, a farm animal, an endangered animal). For example, immunogens can be obtained from an organism (e.g., a pathogenic organism) or an immunogenic portion or component thereof (e.g., a toxin polypeptide or a by-product thereof). By way of example, pathogenic organisms from which immunogenic polypeptides can be obtained include viruses (e.g., picornavirus, enteroviruses, orthomyxovirus, reovirus, retrovirus), prokaryotes (e.g., *Pneumococci, Staphylococci, Listeria, Pseudomonas*), and eukaryotes (e.g., amebiasis, malaria, leishmaniasis, nematodes). It would be understood that the methods described herein and compositions produced by such methods are not to be limited by any particular transgene.

Administration of AAV

A liver-on or a liver-off AAV vector, usually suspended in a physiologically compatible carrier, can be administered to a subject (e.g., a human or non-human mammal). Suitable carriers include saline, which may be formulated with a variety of buffering solutions (e.g., phosphate buffered saline), lactose, sucrose, calcium phosphate, gelatin, dextran, agar, pectin, and water. A viral vector typically is administered in sufficient amounts to transduce or infect the desired cells and to provide sufficient levels of gene transfer and expression to provide a therapeutic benefit without undue adverse effects. Conventional and pharmaceutically acceptable routes of administration include, but are not limited to, direct delivery to an organ such as, for example, the liver or lung, orally, intranasally, intratracheally, intrathecally, by inhalation, intravenously, intramuscularly, intraocularly, subcutaneously, intradermally, transmucosally, or by other routes of administration. Routes of administration can be combined, if desired.

The dose of a viral vector administered to a subject will depend primarily on factors such as the condition being treated, and the age, weight, and health of the subject. For example, a therapeutically effective dosage of a viral vector to be administered to a human subject generally is in the range of from about 0.1 ml to about 10 ml of a solution containing concentrations of from about $1\times10e1$ to $1\times10e12$ genome copies (GCs) of viruses (e.g., about $1\times10e3$ to $1\times10e9$ GCs). Transduction and/or expression of a transgene can be monitored at various time points following administration by DNA, RNA, or protein assays. In some instances, the levels of expression of the transgene can be monitored to determine the frequency and/or amount of dosage. Dosage regimens similar to those described for therapeutic purposes also may be utilized for immunization.

A second "corresponding" subject (e.g., mammalian subject), as used herein, refers to a subject that is the same type (e.g., species and, where applicable, breed or strain) as the first subject, and does not substantially differ from the first subject in AAV transduction.

In accordance with the present invention, there may be employed conventional molecular biology, microbiology, biochemical, and recombinant DNA techniques within the skill of the art. Such techniques are explained fully in the literature. The invention will be further described in the following examples, which do not limit the scope of the methods and compositions of matter described in the claims.

EXAMPLES

Example 1—The Anc AAV Capsid Libraries

Libraries of the AAV capsid were previously generated (referred to as Anc AAVs) based on ancestral sequence reconstruction. Anc AAVs approximate a putative ancestral state of an AAV phylogeny. This work was based on recreating ancestors along a putative phylogeny of the majority of known primate AAVs including AAV1, AAV2, AAV3, AAV6, AAV7, AAV8, and AAV9 (but not AAV4 or AAV5). This process inferred a probability score (posterior probability) to each of the 20 amino acids at each of the positions along the AAV capsid protein VP1. These approaches were described in Zinn et al. (2015, Cell Reports, 12(6):1056-68) and WO 2015/054653, and were used to generate two Anc libraries, referred to as Anc126 and Anc127.

These Anc126 and Anc127 variant libraries were constructed using molecular cloning and DNA synthesis in a pooled format, i.e., all variants of a particular library were parallel synthetized in the same receptacle. The design of this library plasmid was such that it encodes the viral capsid sequence within the AAV vector genome. In addition, the design of these libraries includes a short DNA identifier or barcode that allows for efficient and high throughput next generation sequencing (NGS) using short read NGS platforms such as those sold by Illumina. In the experiments outlined herein, each barcode identified a single AAV capsid variant and each capsid variant was identified by a unique barcode.

FIG. 1 illustrates a minimal design of a library construct for AAV variants within pooled barcoded library. Elements of an AAV library plasmid construct are AAV Inverted Terminal Repeat (ITR), one or more promoter(s) or poly adenylation signal(s) (polyA), which can be from AAV or heterologous to AAV, an AAV capsid variant open reading frame (ORF), and a barcode identifier for the capsid. It would be understood that variations on the construct shown in FIG. 1 are possible, such as the presence of the barcode outside of the expression cassette yet within the ITRs, one promoter driving the capsid gene and another a transcript with the barcode, and/or various elements for promoter(s) and polyA signal(s).

This pooled plasmid library was used to generate a viral vector library by transfection into HEK293 cells together with an adenoviral helper gene plasmid construct and a plasmid containing the AAV rep expression cassette. Importantly, this transfection was performed under low plasmid concentration conditions to maximize the degree of "self-packaging," i.e., the packaging of a viral genome for a particular capsid within the capsid. The viral library was next assessed for its diversity using Illumina NGS with a focused sequencing of the barcoding region. This data provided a count for each barcode identified within the NGS sample of the viral library preparation and, thereby, gave a relative representation of the barcode (and hence capsid variant) diversity. NGS sequencing of the barcode indicated that both of the Anc126 and Anc127 libraries were sufficiently diverse and representative across the relevant positions of sequence variation.

Example 2—Summary of Sequence Diversity Across the AAVR Footprint

FIG. 2 is an alignment of Anc126 (SEQ ID NO:99) and Anc127 (SEQ ID NO:100) capsid protein sequences relative to the AAV2 VP1 capsid protein sequence (SEQ ID NO:1) using the MUSCLE algorithm (Edgar, R. C. (2004) MUSCLE: multiple sequence alignment with high accuracy and high throughput *Nucleic Acids Res.* 32(5):1792-1797) with the following parameters: distance measure kmer6_6, clustering method UPGMB, tree rooting method pseudo, distance weighting CLUSTALW, anchor spacing 32, open gap penalty −1. The residues predicted to be located within the AAVR footprint are boxed. Additionally, Table 2 below provides each of the predicted AAVR footprint residues in AAV2 and the corresponding residue in Anc80, Anc126, and Anc127, with dots (".") representing conserved amino acids. Positions at which alternate residues were observed are shown in Table 2, indicating that these sites of variation were ambiguous in the Anc library.

TABLE 2

The residue and positions on the AAV VP1 capsid protein predicted to be involved in AAVR-AAV binding

| Position | AAV2 | Anc80 | Anc126 | Anc127 |
|---|---|---|---|---|
| 263 | Q | . | . | . |
| 264 | S | . | . | . |
| 265 | G | . | . | . |
| 266 | A | A/G | . | . |
| 267 | S | . | . | . |
| 268 | N | . | . | . |

TABLE 2-continued

The residue and positions on the AAV VP1 capsid protein predicted to be involved in AAVR-AAV binding

| Position | AAV2 | Anc80 | Anc126 | Anc127 |
|---|---|---|---|---|
| 271 | H | T | . | . |
| 382 | N | . | . | . |
| 383 | G | . | . | . |
| 384 | S | . | . | . |
| 385 | Q | . | . | . |
| 446 | S | . | N/S | R/S |
| 471 | R | A | A/S | A/S |
| 502 | W | . | . | . |
| 503 | T | . | . | . |
| 528 | D | . | . | . |
| 529 | D | . | . | . |
| 589 | Q | A | A | A |
| 706 | K | . | . | . |
| 708 | V | T | T/A | . |

Example 3—Identifying Sequences Associated with Liver Uptake

The AAV126 and AAV127 variant libraries were injected into C57Bl/6 mice via an intravenous route at a dose of 6.2e10 GCs total to interrogate the impact of the variant sites within the library on liver tropism, especially those sites identified in Table 2, which correspond to the AAVR footprint. Animals were sacrificed and tissues were harvested at 28 days following injection. Tissues were subjected to DNA isolation, after which the DNA samples were amplified using PCR with primers flanking the barcode sequence. PCR amplicons underwent a second amplification to incorporate Illumina NGS indexes. These NGS samples were subsequently sequenced using Illumina NGS instrumentation MiSeq® or NovaSeq®. Data was subsequently analyzed for each variant to represent enrichment of barcodes in liver as compared to the input injected virus using the barcode counts of the liver versus those in the input viral preparation. A quantitative readout of the liver tissue was obtained, which indicated the extent of liver distribution of each member of the respective library.

Figure 3:
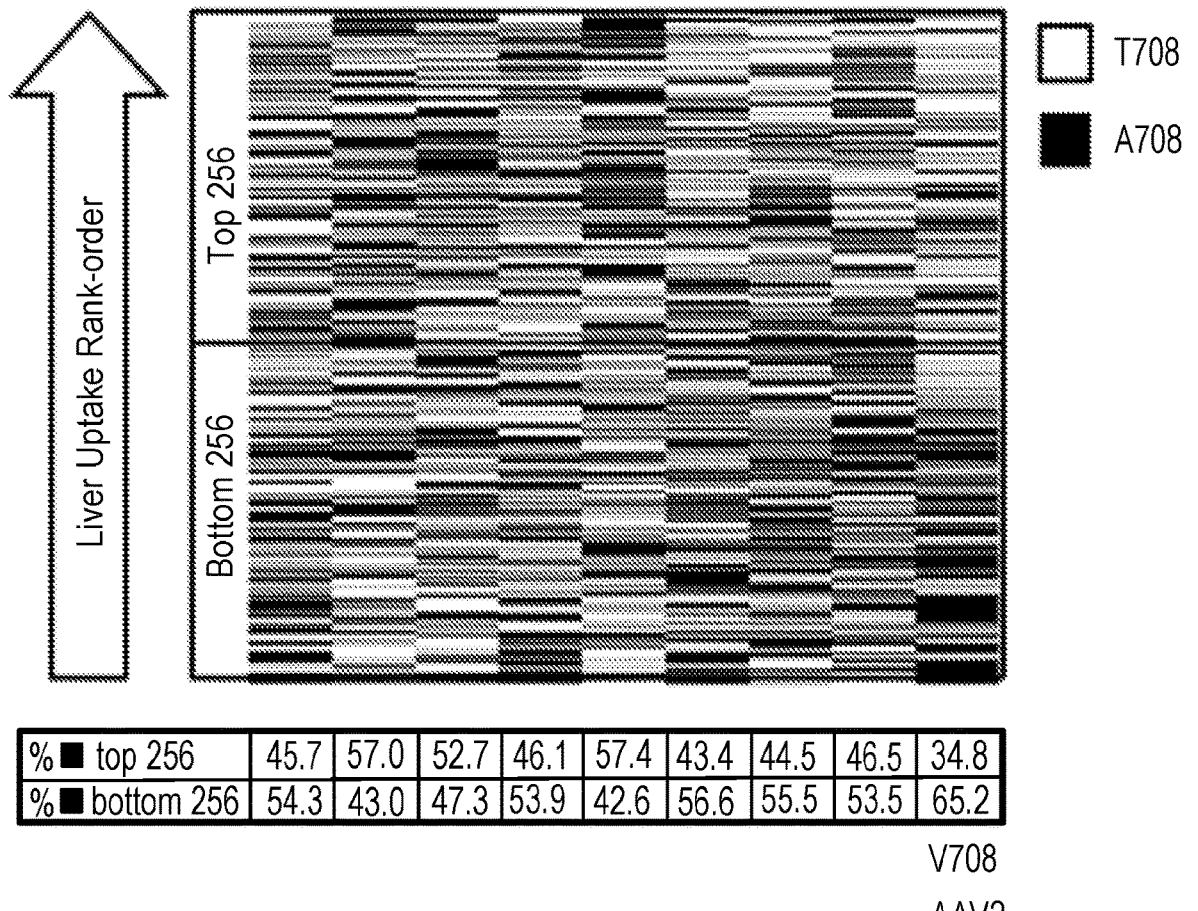
FIG. 3 is a fingerprint plot that illustrates relative rank of Anc126 variants in terms of murine liver targeting. Each Anc126 variant was ranked from top to bottom based on liver uptake following IV administration of a multiplex Anc126 library. Columns show the nine positions of variation that make up the diversity within Anc126. Each position of variation has two possible residues, represented here as black or white. The percent of variants with that particular residue (i.e., black) in either the top or bottom half rank-order is indicated in the accompanying table.
Figure 4:
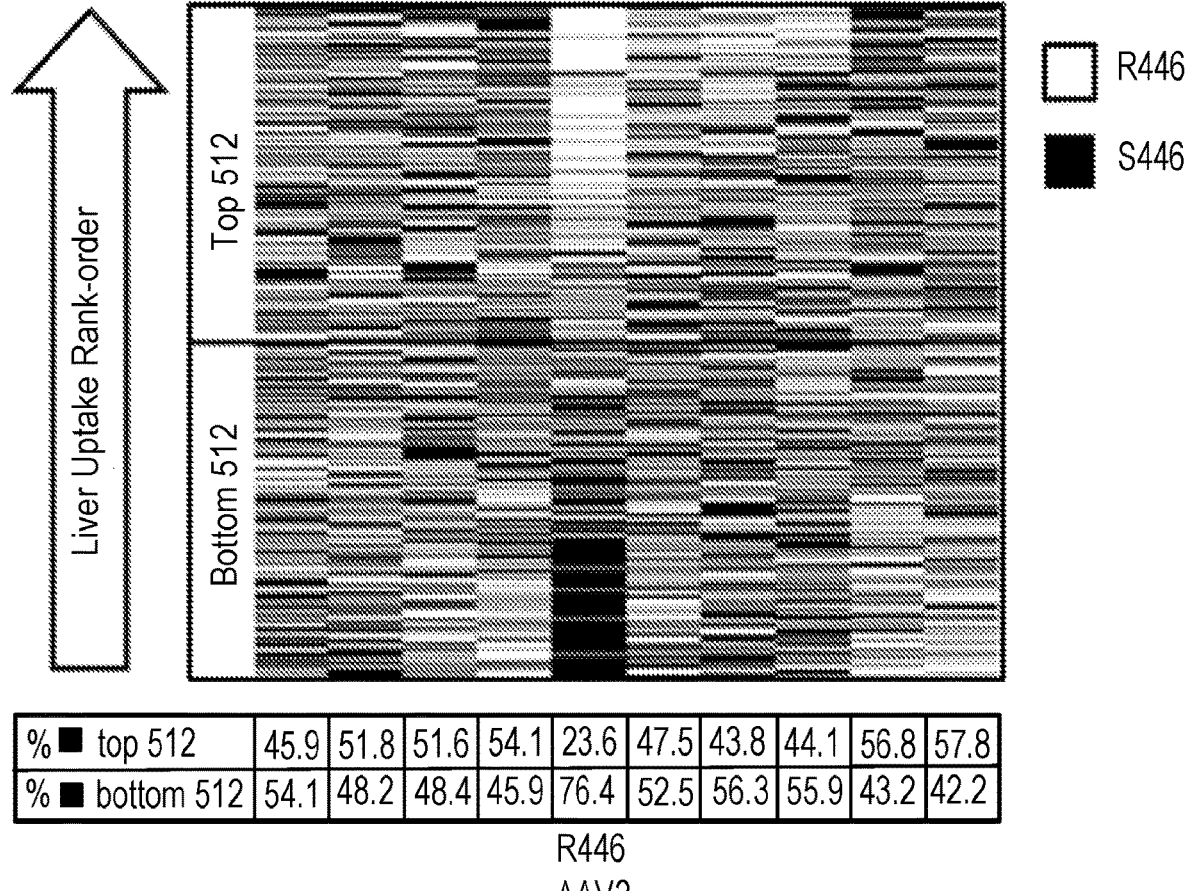
FIG. 4 is a fingerprint plot that illustrates relative rank of Anc127 variants in terms of murine liver targeting. Each Anc127 was ranked from top to bottom based on liver uptake following IV administration of a multiplex Anc127 library. Columns show the ten positions of variation that make up the diversity within Anc127. Each position of variation has two possible residues, represented here as black or white. The percent of variants with that particular residue (i.e., black) in either the top or bottom half rank-order is indicated in the accompanying table.
Figure 5A:
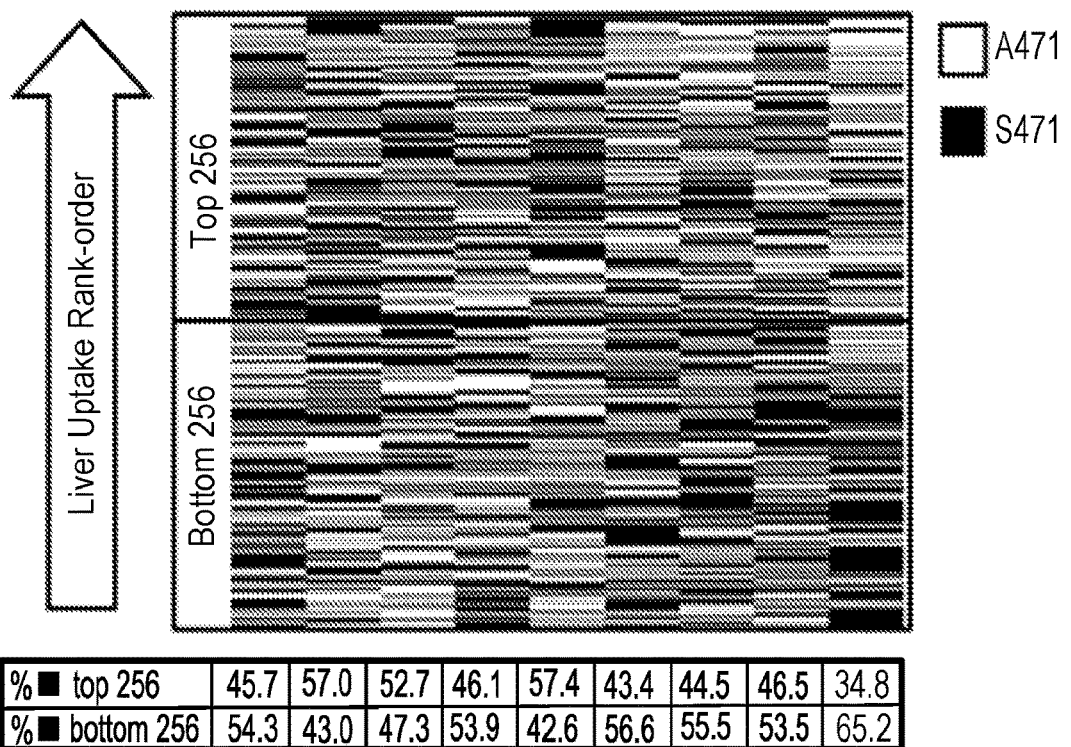
FIGS. 5A-5B are fingerprint plots that illustrate relative rank order of Anc126 (5A) and Anc127 (5B) variants in terms of murine liver targeting. Each Anc126 and Anc127 variant was ranked from top to bottom based on liver uptake following IV administration of a multiplex Anc126 and Anc127 libraries. Columns show the positions of variation that make up the diversity within Anc126 and Anc127 libraries. Each position of variation has two possible residues, represented here as black or white. The percent of variants with that particular residue (i.e., black) in either the top or bottom half rank-order is indicated in the accompanying table.
Figure 5B:
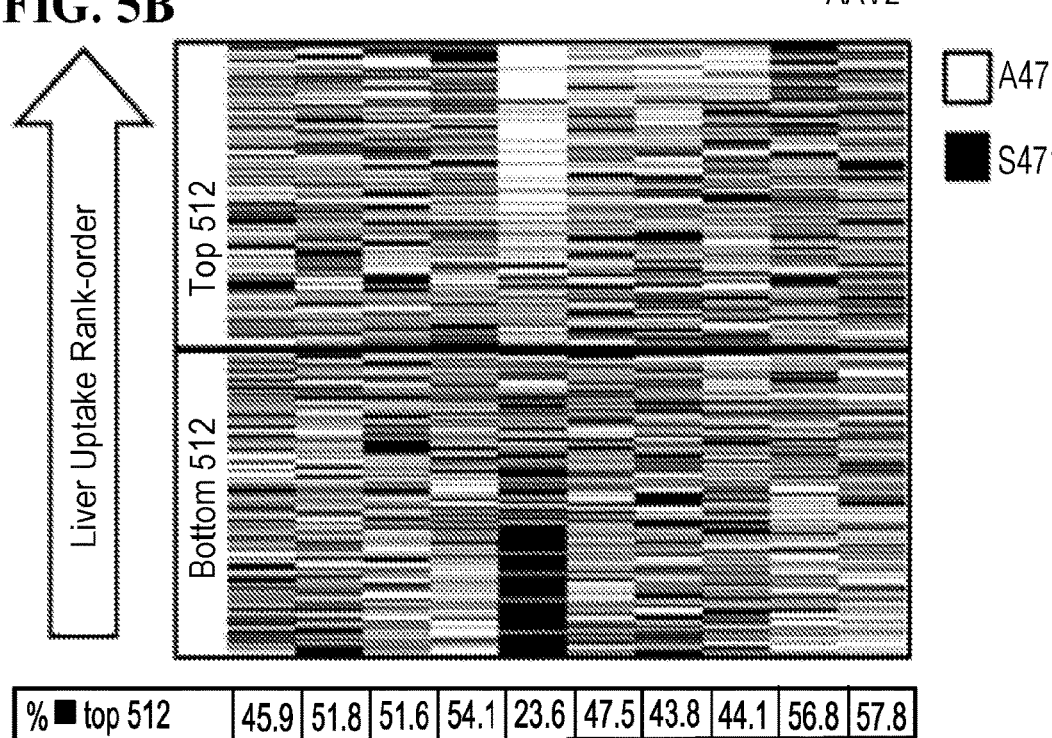

FIG. 3 and FIG. 4 represent the relative performance data in the liver for Anc126 and Anc127 members, respectively, as does FIGS. 5A and 5B. The analysis provided here, in the form of graphs referred to as a "fingerprint plots," illustrates the performance for all members of the Anc126 or Anc127 vector libraries in rank order from top to bottom. In addition, columns represent the sites of variation within the Anc126 or Anc127 library design. Each site of variation is ambiguous, i.e., has two different residues that can be encoded in that position.

Data in FIG. 3 indicates that position P9, which corresponds to residue 708 in AAV2 (SEQ ID NO:1), is the only position in this list that overlaps with the AAVR footprint and that demonstrated an enrichment of white variants (a T at position 708) versus black variants (an A at position 708) in the liver. The black variants were underrepresented in the liver (34.8% of the top 256 performing variants), indicating that the T in position 708 of Anc126 enhanced liver targeting versus an A in the same position, which reduced liver targeting. Thus, A708 variants were less efficient in liver uptake compared to T708 variants.

Similarly, data in FIG. 4 indicates that position P5, which corresponds to residue 446 in AAV2 (SEQ ID NO:1), abuts the AAVR footprint and is one of two positions in this list that demonstrated an enrichment of white variants (R446)

versus black variants (S446) in the liver. The white variants were underrepresented in the liver (23.6% of the top 512 performing variants), indicating that an R in position 446 of Anc127 enhanced liver targeting versus an S in the same position, which reduced liver targeting.

The data in FIG. 5 indicates that position P8 in Anc126 and P7 in Anc127, which both align with residue 471 of AAV2 (SEQ ID NO:1), exhibit only a faint effect with changes at position 471, with viruses having an A471 sequence being slightly more likely to be liver targeted as compared to viruses having an S471 sequence. Since neither the white variants (A471) nor the black variants (S471) strongly determined liver enrichment, not every residue of the predicted AAVR footprint, when conservatively altered, significantly modulates the AAVR-AAV interaction. In addition, an A to S change is a relatively modest change, which also may lead to a less appreciable effect.

Collectively, these data support the discovery that modulation of AAV-AAVR binding alters the uptake by the liver and, by extension, other tissues. Specifically, this analysis indicates that positions 446, 471, and 708 within the AAVR footprint appear to be involved in the bio-distribution of AAV to, or away from, the liver.

Example 4—Use of an Exemplary Liver Toggle in Non-Human Primates

The AAVAnc80, Anc81, Anc110, and Anc126 variant libraries were injected into the cerebrospinal fluid of two female rhesus macaques (*M. mulatta*) via an intracisternal route at a dose of 7.75e10 GC/kg to interrogate the impact of the variant sites within the library on CNS, systemic escape, and liver tropism. Animals were sacrificed and tissues were harvested at 7 days following injection. Tissues were subjected to DNA isolation, after which the DNA samples were amplified using PCR with primers flanking the barcode sequence. PCR amplicons underwent a second amplification to incorporate Illumina NGS indexes. These NGS samples were sequenced using Illumina NGS instrumentation MiSeq® or NovaSeq®. Data was subsequently analyzed for each variant to represent enrichment of barcodes in liver as compared to the input injected virus using the barcode counts of the liver versus those in the input viral preparation. A quantitative readout of the liver tissue was obtained, which indicated the extent of liver distribution of each member of the respective library.

Figure 6B:
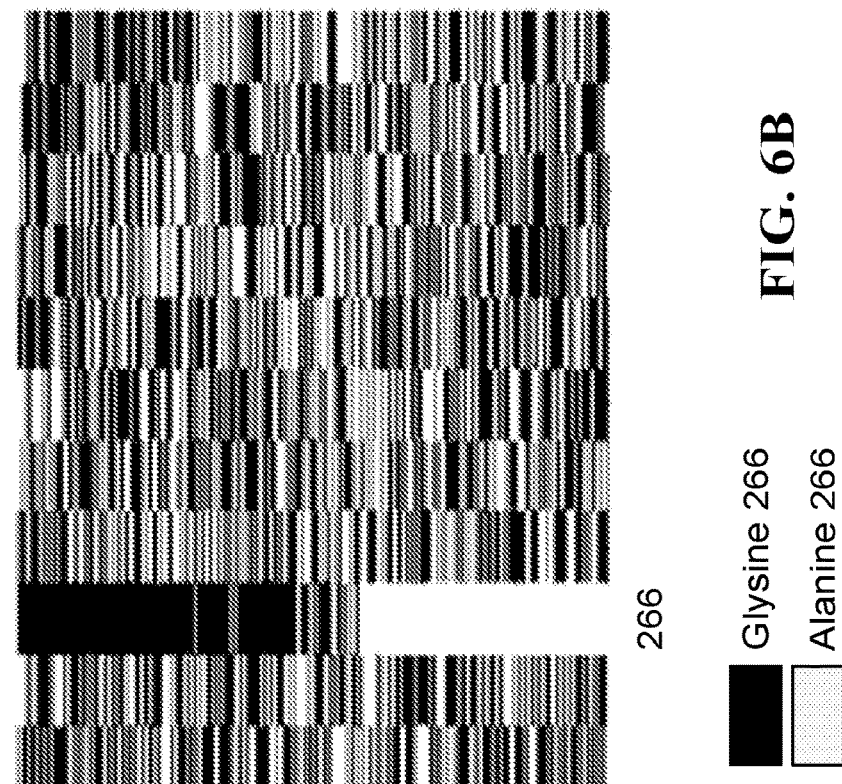
FIGS. 6A-6B are fingerprint plots of Anc80 libraries having a glycine (black) or an alanine (white) at residue 266 administered to two different non-human primates.
Figure 6A:
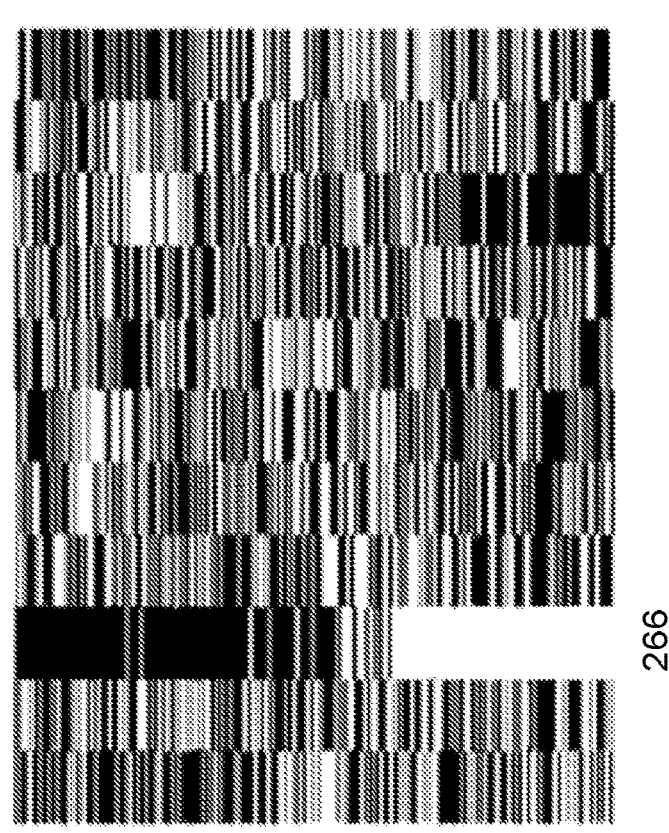

FIG. 6 represents the relative performance data in the liver for Anc80 library. The analysis provided here, in the form of graphs referred to as a "fingerprint plots," illustrates the performance for all members of the Anc80 vector library in rank order from top to bottom. In addition, columns represent the sites of variation within the Anc80 library design. Each site of variation is ambiguous, i.e., has two different residues that can be encoded in that position.

Data in FIG. 6 indicates that position P3, which corresponds to residue 266 in AAV2 (SEQ ID NO:1), is the only position in this list that overlaps with the AAVR footprint and that demonstrated an enrichment of black variants (a G at position 266) versus white variants (an A at position 266) in the liver. The white variants were underrepresented in the liver (6.7% of the top 1024 performing variants), indicating that the G in position 266 of Anc80 enhanced liver targeting versus an A in the same position, which reduced liver targeting. Thus, A266 variants were less efficient in liver uptake compared to G266 variants.

Collectively, these data support the discovery that modulation of AAV-AAVR binding alters the uptake by the liver and, by extension, other tissues. Specifically, this analysis indicates that positions 266, 446, 471, and 708 within the AAVR footprint appear to be involved in the bio-distribution of AAV to, or away from, the liver.

OTHER EMBODIMENTS

It is to be understood that, while the methods and compositions of matter have been described herein in conjunction with a number of different aspects, the foregoing description of the various aspects is intended to illustrate and not limit the scope of the methods and compositions of matter. Other aspects, advantages, and modifications are within the scope of the following claims.

Disclosed are methods and compositions that can be used for, can be used in conjunction with, can be used in preparation for, or are products of the disclosed methods and compositions. These and other materials are disclosed herein, and it is understood that combinations, subsets, interactions, groups, etc. of these methods and compositions are disclosed. That is, while specific reference to each various individual and collective combinations and permutations of these compositions and methods may not be explicitly disclosed, each is specifically contemplated and described herein. For example, if a particular composition of matter or a particular method is disclosed and discussed and a number of compositions or methods are discussed, each and every combination and permutation of the compositions and the methods are specifically contemplated unless specifically indicated to the contrary. Likewise, any subset or combination of these is also specifically contemplated and disclosed.

SEQUENCE LISTING (210 sequences)

SEQ ID NO: 1 - protein, 735 aa, Adeno-associated virus [sequence omitted]

SEQ ID NO: 2-3 - skipped (2 entries)

SEQ ID NO: 4 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 5 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 6 - protein, 736 aa, Adeno-associated virus
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 7 - protein, 736 aa, Adeno-associated virus
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 8 - protein, 737 aa, Adeno-associated virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 9 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 10 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 11 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 12 - protein, 736 aa, Adeno-associated virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 13 - protein, 736 aa, Adeno-associated virus
MAADGYLPDWLEDNLSEGIREWWALKPGAPQPKANQQHQDNARGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSVGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 14 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGESESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 15 - skipped

SEQ ID NO: 16 - protein, 736 aa, Adeno-associated virus; identical to SEQ ID NO: 6

SEQ ID NO: 17 - protein, 734 aa, Adeno-associated virus
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 18 - protein, 736 aa, Adeno-associated virus; identical to SEQ ID NO: 4

SEQ ID NO: 19 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSPSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGRLPPFPADVFMIPQYGYLTLNNGSQAVGRSSSYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSAGQVSVEIEWELQKENSKRWNPEVQYTSNYAKSANVDFTVDNNGLYTEPRPIGTRYLTRPL

SEQ ID NO: 20 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 21 - protein, 736 aa, Adeno-associated virus
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAETAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 22 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTPFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIVQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 23 - protein, 736 aa, Adeno-associated virus; identical to SEQ ID NO: 5

SEQ ID NO: 24 - protein, 735 aa, Adeno-associated virus
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNESQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 25 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDSHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 26 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLGYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 27 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYPKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 28 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPASPSGLGTNTMATGSGAPMADNNEGADGVGNSSGNWHCDSTWMGDRVVTTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 29 - protein, 735 aa, Adeno-associated virus
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSGYQLPYVLGSAHQGCLPPFPADVFMVPQYGYPTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAVASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 30 - protein, 738 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQTSNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSAEIEWELQKENSKRWNPEIQYTSNYYKSTNVDFAVNTEGVYSEPRPIGTRYLTRNL

SEQ ID NO: 31 - protein, 729 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPMADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQGLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQPSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLPRNL

SEQ ID NO: 32 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKCWNPEIQYTSNYYKSTNVDFAVNTEGVYSEPRPIGTRYLTRNL

SEQ ID NO: 33 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLSLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIQDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVGQDRDVYLQGPTWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 34 - protein, 738 aa, Adeno-associated virus
MVADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAELQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCQPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWEPQKENSKRWNPEIQYTSNYYKSTNVDFAVNTEGVYSEPRPIGTRYLTRNL

SEQ ID NO: 35 - protein, 735 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPRKLRFKLFNIQVKEVTTDDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMDGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 36 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPHLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQLIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGNLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNMGYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYGTGQVSVEIEWELQKENSKRWNPEIQYTSNYYKSTNVDFAVNTEGVYSEPRPIGTRYLTRNL

SEQ ID NO: 37 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANSLTSTIQVFTDSEYQLPYVLGSAHQGCLPPFPADVFMIPQYGYLTPNNGSQAVGRSSFYCLEYFPSQMLRTGNNFSFSYTFEDVPFHSSYAHSQSLDRLMNPLIDQYLYYLSRTQSTGGTAGTQQLLSSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 38 - protein, 728 aa, Adeno-associated virus
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGETGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 39 - protein, 735 aa, Adeno-associated virus [sequence omitted]

SEQ ID NO: 40 - protein, 735 aa, Adeno-associated virus
MAADGYLPDWLEDTLSEGIRQWWKLKPGPPPPKPAERHKDDSRGLVLPGYRYLGPFNGLDKGEPVNEADAAALEHDKAYDRQLDSGDNPYLKYNHVDAEFQERLKEDTSFGGNLGRAVFQAKKRILEPLGLVEEPVKAAPGEKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGHFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPPMGGFGLKHPPPQILIKNTPVPANPSTTFSAAKFASFITQYSTGQVSVEIEWELQKENSKRWNPEIQYTSNYNKSVNVDFTVDTNGVYSEPRPIGARYLTRNL

SEQ ID NO: 41 - protein, 733 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIESPDSSTGIGKKGQQPAKKKLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMSAQAKNWLPGPCYRQQRVSTTVSQNNNSNFAWTGATKYHLNGRDSLVNPGVAMATHKGDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRSL

SEQ ID NO: 42 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRRNPEIQYTSNYYKSTNVDFAVNTEGVYSEPRPIGTRYLTRNL

SEQ ID NO: 43 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSGYQLPYVLGSAHQGCLPPFPADVFMVPQYGYLTLNNGSQAVGRSSFYCLEYFPSQMLRTGNNFTFSYTFEDVPFHSSYAHGQSLDRLMNPLIDQYLYYLSRTNTPSGTTTMSRLQFSQAGASDVRDQSRNWLPGPCYRQQRVSKTAADNNNSDYSWTGATKYHLNGRDSLVNPGPAMASHKDDEEKYFPQSGVLVFGKQDSGKTNVDIEKVMITDEEEIRTTNPAATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFVSFITQYSTGQVSVEIEWELQKENSKRWNPEIQYTSNYNKSVNVDFTVDTNGVYSEPRPIGTRYLTRNL

SEQ ID NO: 44 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPRPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 45 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKGDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGGRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQTLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 46 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTCNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTYLQSGNTQAATSDVNTQGVLPGMVWQDRDVYLRGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 47 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEGPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 48 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHPPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNRLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLVGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 49 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWAQPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGALQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHRGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 50 - protein, 735 aa, Adeno-associated virus
MAADGYLPDWLEDTLSEGIRQWWKLKPGPPPPKPAERHQDNSRGLVLPGYKYLGPSNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGCSTPWGYFDFNRFHCHFSPRDWQRLINNNWGFRPKRLNFKLFNIQVKEVTQNDGTTTIANNLTSTVQVFTDSEYPLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPCPIGTRYLTRNL

SEQ ID NO: 51 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCRFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQGLDRLMNPLIDQYLYYLNRTQTASGTQQSRLLFSQAGPTSMSLQAKNWLPGPCYRQQRLSKQANDNNNSNFPWTGATKYHLNGGDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLRGPIWAKIPHADGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 52 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLRQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYYLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 53 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLVDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 54 - protein, 734 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLECFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYHLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 55 - protein, 735 aa, Adeno-associated virus
MAADGYPPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQRPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNRQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 56 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNGGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANGNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLTGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 57 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLESGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMASGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNSWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLLNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSSKFASFITQYSTGQVSVEIEWELQKENSKRWNPEIQYTSNYNKSVNVDFTVDTNGVYSEPRPIGTRYPTRNL

SEQ ID NO: 58 - protein, 736 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLRPGLRKPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLDDRVIATSTRTWALPTYNNHLYKQISSQSGACNDNHYFGYSTPWGYFDFNRFHCHFSPRDWQRLINSNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFQFSYTFEDVPFHSSYAHCQSLDRLMNPLIDQYLYYLNKTQTNSGTLQQSRLLFSQAGPTNMSLQAKNWLPGPCYRQQRLSKQANDNNNCNFPWTAATKYHLNGRDSLVNPGPAMASHKDDEEKFFPMHGTLIFGKQGTNANDADLENVMITDEEEIRPTNPVATEQYGTVSNNLQNSNTGPTTGTVNHQGALPGMVWQDRDVYLQGPIWAKIPHTDGHFHPSPLMGGFGLKHPPPQIMIKSTPVPANPPTNFSSAKFASSITQYSTGQVSVEIEWELQKENSKRWNPEIQYTSNYNKSVNVDFTVDTNGVYSEPRPIGTRYLTRNL

SEQ ID NO: 59 - protein, 735 aa, Adeno-associated virus
MAADGYLPDWLEDTLSEGIRQWWKLKPGPPPPKPAERHKDGSRGLVLPGYKYLGPFNGLDKGEPVNEADAAALEHDKAYDRQLNSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSPFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDNNGVYSEPRPIGTRYLTRNL

SEQ ID NO: 60 - protein, 735 aa, Adeno-associated virus
MAADGYLPDWLEDTLSEGIRQWWKLKPGPPPPKPAERHKDDSRGLVLPGYKYLGPFNGLYKGEPVDEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDRQRLINNNWGFRPKRLNFKLFNIQVKEVTQNDGTTTIANNLTSTVQVFTDSGYQLPYVLGLAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKEDSKRWNPEIQYTSNYNKPVNVDFTVDTNGVYSEPRPIGTRYLTRNL

SEQ ID NO: 61 - protein, 735 aa, Adeno-associated virus
MAADGYLPDWLEDTLSEGIRQWWKLKPGPPPPKPAERHKDDSRGLVLPGYKYLGPFNGLYKGEPVNEADAAALEHDKAYDRQLDSGDNPYLKYNHAGAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQDSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 62 - protein, 735 aa, Adeno-associated virus
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYRLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 63 - protein, 735 aa, Adeno-associated virus
MAADGYLPDWLEDTLSEGIRQWWKLKPGPPPPKLAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFTVPQYGYLTLNNGSQAVGRSSFYCLEYFPSQMLRTGNNLTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNYSSAKFASFITQYSTGQVSVEIEWELRKENSKRWNPEIQYTSNYNKSVNVDFTVDTNGVYSEPRPIGTRYLTRNL

SEQ ID NO: 64 - protein, 735 aa, Adeno-associated virus
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLVNNNRGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 65 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPLGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQVLRTGNNFTFSYTFEDVPFHSSYAHSQSLDRLMNPLIDQYLYYLARTQSNPGGTSGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 66 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 67 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQRRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 68 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLAEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTGDGVTTIANNLTSTVQVFSDSEYQLPYVLGSAHQGCLPPFPADVFMIPQYGYLTLNNDSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 69-91 - skipped (23 entries)

SEQ ID NO: 92 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGASTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITSEEEIKTTNPVATEEYGTVATNLQSSNTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 93 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPAKKRLNFGQTGDSESVPDPQPLGEPPAAPSGVGSNTMAAGGGAPMADNNEGADGVGNASGNWHCDSTWLGDRVITTSTRTWALPTYNNHLYKQISNSQSGGSTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTGGTAGNRTLQFSQAGPSSMANQAKNWLPGPCYRQQRVSKTTNQNNNSNFAWTGATKYHLNGRDSLVNPGVAMATHKDDEDRFFPSSGVLIFGKQGAGNDNVDLDNVMITSEEEIKTTNPVATEEYGVVATNLQSANTAPQTGTVNSQGALPGMVWQNRDVYLQGPIWAKIPHTDGNFHPSPLMGGFGLKHPPPQILIKNTPVPANPPTTFSPAKFASFITQYSTGQVSVEIEWELQKENSKRWNPEIQYTSNYNKSTNVDFAVDTEGVYSEPRPIGTRYLTRNL

SEQ ID NO: 94 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQREPDSSTGIGKKGQQPAKKRLNFGQTGDSESVPDPQPLGEPPAAPSGVGSNTMAAGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGGTAGTQTLQFSQAGPSSMANQAKNWLPGPCYRQQRVSTTTNQNNNSNFAWTGATKYHLNGRDSLVNPGVAMATHKDDEDRFFPSSGVLIFGKQGAGNDNVDYSNVMITSEEEIKTTNPVATEEYGVVATNLQSANTAPQTGTVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 95 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQREPDSSTGIGKKGQQPARKRLNFGQTGDSESVPDPQPLGEPPAAPSGVGSNTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGGTAGTQTLQFSQAGPSNMANQAKNWLPGPCYRQQRVSTTTSQNNNSNFAWTGATKYHLNGRDSLVNPGVAMATHKDDEDRFFPSSGILIFGKQGAGKDNVDYSNVMLTSEEEIKTTNPVATEEYGVVADNLQQQNTAPQIGTVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 96 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSGVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTAGTQQLLFSQAGPSNMSAQAKNWLPGPCYRQQRVSTTLSQNNNSNFAWTGATKYHLNGRDSLVNPGVAMATHKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 97 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTAGTQQLLFSQAGPSNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 98 - protein, 737 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPLGEPPAAPSGVGSGTMAAGGGAPMADNNEGADGVGNASGNWHCDSTWLGDRVITTSTRTWALPTYNNHLYKQISSQSAGSTNDNTYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYTFEDVPFHSSYAHSQSLDRLMNPLIDQYLYYLARTQSTTGGTAGNRELQFYQAGPSTMAEQAKNWLPGPCYRQQRVSKTLDQNNNSNFAWTGATKYHLNGRNSLVNPGVAMATHKDDEDRFFPSSGVLIFGKTGAANKTTLENVLMTNEEEIKTTNPVATEEYGVVSSNLQSANTAPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYDKSTNVDFAVDSEGVYSEPRPIGTRYLTRNL

SEQ ID NO: 99 - protein, 735 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKSGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGASNDNHYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTSGTAQNRELQFSQAGPSSMANQAKNWLPGPCYRQQRVSKTANDNNNSNFAWTGATKYHLNGRDSLVNPGPAMASHKDDEDKFFPMSGVLIFGKQGAGASNVDLDNVMITDEEEIKTTNPVATEQYGTVATNLQSSNTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSANVDFTVDTNGVYSEPRPIGTRYLTRNL

SEQ ID NO: 100 - protein, 735 aa, Adeno-associated virus
MAADGYLPDWLEDNLSEGIREWWDLKPGAPQPKANQQHQDDGRGLVLPGYKYLGPFNGLDKGEPVNEADAAALEHDKAYDQQLKAGDNPYLKYNHADAEFQERLQEDTSFGGNLGRAVFQAKKRVLEPLGLVEEAAKTAPGKKRPVEQSPQEPDSSSGIGKSGQQPARKRLNFGQTGDSESVPDPQPLGEPPAAPSGVGSNTMASGGGAPMADNNEGADGVGNSSGNWHCDSTWLGDRVITTSTRTWALPTYNNHLYKQISSQSGASNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTTSGTTQQSRLQFSQAGPSSMAQQAKNWLPGPCYRQQRVSKTANDNNNSNFAWTGATKYHLNGRDSLVNPGPAMASHKDDEEKFFPMHGVLIFGKQGTGASNVDLDNVMITDEEEIRTTNPVATEQYGTVATNLQSSNTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 101 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRTLQFSQAGPSSMANQAKNWLPGPCYRQQRVSKTANQNNNSNFAWTGATKYHLNGRDSLVNPGPAMATHKDDEDKFFPMSGVLIFGKQGAGNSNVDLDNVMITNEEEIKTTNPVATEQYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 102 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGASTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITNEEEIKTTNPVATEEYGTVATNLQSANTAPATGTVNSQGALPGMVWQNRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 103 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITSEEEIKTTNPVATEEYGTVATNLQSSNTAPATGTVNSQGALPGMVWQERDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 104 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMASGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITSEEEIKTTNPVATEEYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 105 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRTLQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITNEEEIKTTNPVATEEYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 106 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRTLQFSQAGPSSMANQAKNWLPGPCYRQQRVSKTANQNNNSNFAWTGATKYHLNGRDSLVNPGPAMATHKDDEDKFFPMSGVLIFGKQGAGNSNVDLDNVMITSEEEIKTTNPVATEQYGTVATNLQSSNTAPATGTVNSQGALPGMVWQNRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 107 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRTLQFSQAGPSSMANQAKNWLPGPCYRQQRVSKTANQNNNSNFAWTGATKYHLNGRDSLVNPGPAMATHKDDEDKFFPMSGVLIFGKQGAGNSNVDLDNVMITSEEEIKTTNPVATEEYGTVATNLQSSNTAPATGTVNSQGALPGMVWQNRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 108 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMASGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRELQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITNEEEIKTTNPVATEQYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 109 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPAKKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGASTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTSGTAGNRTLQFSQAGPSSMANQAKNWLPGPCYRQQRVSKTANQNNNSNFAWTGATKYHLNGRDSLVNPGPAMATHKDDEDKFFPMSGVLIFGKQGAGNSNVDLDNVMITSEEEIKTTNPVATEQYGTVATNLQSSNTAPATGTVNSQGALPGMVWQNRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 110 - protein, 736 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGTAGTQTLQFSQAGPSSMANQARNWVPGPCYRQQRVSTTTNQNNNSNFAWTGATKYHLNGRDSLMNPGVAMASHKDDEDRFFPSSGVLIFGKQGAGNDNVDYSQVMITNEEEIKTTNPVATEEYGAVATNNQSANTQAQTGLVHNQGVLPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 111 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQREPDSSTGIGKSGQQPAKKRLNFGQTGDSESVPDPQPLGEPPAAPSGVGSNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTGGTAGTQTLQFSQAGPSSMANQARNWVPGPCYRQQRVSTTTNQNNNSNFAWTGATKYHLNGRDSLMNPGVAMASHKDDEDRFFPSSGVLIFGKQGAGNDNVDYSNVMITSEEEIKTTNPVATEEYGVVATNHQSANTQAQTGTVQNQGILPGMVWQNRDVYLQGPIWAKIPHTDGNFHPSPLMGGFGLKHPPPQILIKNTPVPADPPTTFNQAKLNSFITQYSTGQVSVEIEWELQKENSKRWNPEIQYTSNYYKSTNVDFAVNTEGVYSEPRPIGTRYLTRNL

SEQ ID NO: 112 - protein, 735 aa, Artificial Sequence
  source: /note="Description of Artificial Sequence: Synthetic polypeptide"
  VARIANT (263)..(263): /replace="A" or "E" or "T" or "G"
  VARIANT (264)..(264): /replace="T" or "A" or "V" or "S"
  VARIANT (265)..(265): /replace="T" or "A" or "V"
  VARIANT (266)..(266): /replace="G" or "D"
  VARIANT (267)..(267): /replace="T"
  VARIANT (271)..(271): /replace="T" or "A"
  VARIANT (382)..(382): /replace="D"
  VARIANT (383)..(383): /replace="T"
  VARIANT (384)..(384): /replace="E"
  VARIANT (385)..(385): /replace="N"
  VARIANT (446)..(446): /replace="N" or "A" or "V" or "R"
  VARIANT (471)..(471): /replace="S" or "A"
  VARIANT (502)..(502): /replace="F"
  VARIANT (503)..(503): /replace="P" or "A"
  VARIANT (528)..(528): /replace="E" or "L"
  VARIANT (529)..(529): /replace="G" or "Q"
  VARIANT (589)..(589): /replace="D" or "A" or "G"
  VARIANT (706)..(706): /replace="D"
  VARIANT (708)..(708): /replace="A" or "T" or "N" or "Q"
  SITE (1)..(735): /note="Variant residues given in the sequence have no preference with respect to those in the annotations for variant positions"
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQGGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 113 - protein, 734 aa, Artificial Sequence
  source: /note="Description of Artificial Sequence: Synthetic polypeptide"
  VARIANT (262)..(262): /replace="A" or "E" or "T" or "G"
  VARIANT (263)..(263): /replace="T" or "A" or "V" or "S"
  VARIANT (264)..(264): /replace="T" or "A" or "V"
  VARIANT (265)..(265): /replace="G" or "D"
  VARIANT (266)..(266): /replace="T"
  VARIANT (270)..(270): /replace="T" or "A"
  VARIANT (381)..(381): /replace="D"
  VARIANT (382)..(382): /replace="T"
  VARIANT (383)..(383): /replace="E"
  VARIANT (384)..(384): /replace="N"
  VARIANT (445)..(445): /replace="N" or "A" or "V" or "R"
  VARIANT (470)..(470): /replace="S" or "A"
  VARIANT (501)..(501): /replace="F"
  VARIANT (502)..(502): /replace="P" or "A"
  VARIANT (527)..(527): /replace="E" or "L"
  VARIANT (528)..(528): /replace="G" or "Q"
  VARIANT (588)..(588): /replace="D" or "A" or "G"
  VARIANT (705)..(705): /replace="D"
  VARIANT (707)..(707): /replace="A" or "T" or "N" or "Q"
  SITE (1)..(734): /note="Variant residues given in the sequence have no preference with respect to those in the annotations for variant positions"
AADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSQGGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLSRTQNQSGSAQNKDLLFSRGSPAGMRVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTQPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSVNVDFTVDNNGLYTEPRPIGTRYLTRPL

SEQ ID NO: 114 - protein, 735 aa, Artificial Sequence
  source: /note="Description of Artificial Sequence: Synthetic polypeptide"
  VARIANT (263)..(263): /replace="A" or "E" or "T" or "G"
  VARIANT (264)..(264): /replace="T" or "A" or "V" or "S"
  VARIANT (265)..(265): /replace="T" or "A" or "V"
  VARIANT (266)..(266): /replace="G" or "D"
  VARIANT (267)..(267): /replace="T"
  VARIANT (271)..(271): /replace="T" or "A"
  VARIANT (382)..(382): /replace="D"
  VARIANT (383)..(383): /replace="T"
  VARIANT (384)..(384): /replace="E"
  VARIANT (385)..(385): /replace="N"
  VARIANT (446)..(446): /replace="N" or "A" or "V" or "R"
  VARIANT (471)..(471): /replace="S" or "A"
  VARIANT (502)..(502): /replace="F"
  VARIANT (503)..(503): /replace="P" or "A"
  VARIANT (528)..(528): /replace="E" or "L"
  VARIANT (529)..(529): /replace="G" or "Q"
  VARIANT (589)..(589): /replace="D" or "A" or "G"
  VARIANT (706)..(706): /replace="D"
  VARIANT (708)..(708): /replace="A" or "T" or "N" or "Q"
  SITE (1)..(735): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSQGGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQNQSGSAQNKDLLFSRGSPAGMRVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTQPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSVNVDFTVDNNGLYTEPRPIGTRYLTRPL

SEQ ID NO: 115 - protein, 736 aa, Artificial Sequence
  source: /note="Description of Artificial Sequence: Synthetic polypeptide"
  VARIANT (263)..(263): /replace="A" or "E" or "T" or "G"
  VARIANT (264)..(264): /replace="T" or "A" or "V" or "S"
  VARIANT (265)..(265): /replace="T" or "A" or "V"
  VARIANT (266)..(266): /replace="G" or "D"
  VARIANT (267)..(267): /replace="T"
  VARIANT (271)..(271): /replace="T" or "A"
  VARIANT (382)..(382): /replace="D"
  VARIANT (383)..(383): /replace="T"
  VARIANT (384)..(384): /replace="E"
  VARIANT (385)..(385): /replace="N"
  VARIANT (446)..(446): /replace="N" or "A" or "V" or "R"
  VARIANT (472)..(472): /replace="S" or "A"
  VARIANT (503)..(503): /replace="F"
  VARIANT (504)..(504): /replace="P" or "A"
  VARIANT (529)..(529): /replace="E" or "L"
  VARIANT (530)..(530): /replace="G" or "Q"
  VARIANT (590)..(590): /replace="D" or "A" or "G"
  VARIANT (707)..(707): /replace="D"
  VARIANT (709)..(709): /replace="A" or "T" or "N" or "Q"
  SITE (1)..(736): /note="Variant residues given in the sequence have no preference with respect to those in the annotations for variant positions"
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQGGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLSRTQGTTSGTTNQSRLLFSQAGPQSMRLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTQPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 116 - protein, 736 aa, Artificial Sequence
  source: /note="Description of Artificial Sequence: Synthetic polypeptide"
  VARIANT (263)..(263): /replace="A" or "E" or "T" or "G"
  VARIANT (264)..(264): /replace="T" or "A" or "V" or "S"
  VARIANT (265)..(265): /replace="T" or "A" or "V"
  VARIANT (266)..(266): /replace="G" or "D"
  VARIANT (267)..(267): /replace="T"
  VARIANT (271)..(271): /replace="T" or "A"
  VARIANT (382)..(382): /replace="D"
  VARIANT (383)..(383): /replace="T"
  VARIANT (384)..(384): /replace="E"
  VARIANT (385)..(385): /replace="N"
  VARIANT (446)..(446): /replace="N" or "A" or "V" or "R"
  VARIANT (472)..(472): /replace="S" or "A"
  VARIANT (503)..(503): /replace="F"
  VARIANT (504)..(504): /replace="P" or "A"
  VARIANT (529)..(529): /replace="E" or "L"
  VARIANT (530)..(530): /replace="G" or "Q"
  VARIANT (590)..(590): /replace="D" or "A" or "G"
  VARIANT (707)..(707): /replace="D"
  VARIANT (709)..(709): /replace="A" or "T" or "N" or "Q"
  SITE (1)..(736): /note="Variant residues given in the sequence have no preference with respect to those in the annotations for variant positions"
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQGGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLSRTQGTTSGTTNQSRLLFSQAGPQSMRLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTQPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRPL

SEQ ID NO: 117 - protein, 736 aa, Artificial Sequence
  source: /note="Description of Artificial Sequence: Synthetic polypeptide"
  VARIANT (264)..(264): /replace="A" or "E" or "T" or "G"
  VARIANT (265)..(265): /replace="T" or "A" or "V" or "S"
  VARIANT (266)..(266): /replace="T" or "A" or "V"
  VARIANT (267)..(267): /replace="G" or "D"
  VARIANT (268)..(268): /replace="T"
  VARIANT (272)..(272): /replace="T" or "A"
  VARIANT (383)..(383): /replace="D"
  VARIANT (384)..(384): /replace="T"
  VARIANT (385)..(385): /replace="E"
  VARIANT (386)..(386): /replace="N"
  VARIANT (447)..(447): /replace="N" or "A" or "V" or "R"
  VARIANT (473)..(473): /replace="S" or "A"
  VARIANT (504)..(504): /replace="F"
  VARIANT (505)..(505): /replace="P" or "A"
  VARIANT (530)..(530): /replace="E" or "L"
  VARIANT (531)..(531): /replace="G" or "Q"
  VARIANT (590)..(590): /replace="D" or "A" or "G"
  VARIANT (707)..(707): /replace="D"
  VARIANT (709)..(709): /replace="A" or "T" or "N" or "Q"
  SITE (1)..(736): /note="Variant residues given in the sequence have no preference with respect to those in the annotations for variant positions"
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSQGGASNDNHYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLSRTQSNPGGTAGNRELQFYQGGPSTMREQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTQAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQVGVDFAVDSQGVYSEPRPIGTRYLTRNL

SEQ ID NO: 118 - protein, 735 aa, Artificial Sequence
  source: /note="Description of Artificial Sequence: Synthetic polypeptide"
  VARIANT (263)..(263): /replace="A" or "E" or "T" or "G"
  VARIANT (264)..(264): /replace="T" or "A" or "V" or "S"
  VARIANT (265)..(265): /replace="T" or "A" or "V"
  VARIANT (266)..(266): /replace="G" or "D"
  VARIANT (267)..(267): /replace="T"
  VARIANT (271)..(271): /replace="T" or "A"
  VARIANT (382)..(382): /replace="D"
  VARIANT (383)..(383): /replace="T"
  VARIANT (384)..(384): /replace="E"
  VARIANT (385)..(385): /replace="N"
  VARIANT (446)..(446): /replace="N" or "A" or "V" or "R"
  VARIANT (471)..(471): /replace="S" or "A"
  VARIANT (502)..(502): /replace="F"
  VARIANT (503)..(503): /replace="P" or "A"
  VARIANT (528)..(528): /replace="E" or "L"
  VARIANT (529)..(529): /replace="G" or "Q"
  VARIANT (589)..(589): /replace="D" or "A" or "G"
  VARIANT (706)..(706): /replace="D"
  VARIANT (708)..(708): /replace="A" or "T" or "N" or "Q"
  SITE (1)..(735): /note="Variant residues given in the sequence have no preference with respect to those in the annotations for variant positions"
AADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNQGGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMRNQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTQPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSVSVDFAVNTEGVYSEPRPIGTRYLTRNL

SEQ ID NO: 119 - protein, 736 aa, Artificial Sequence
  source: /note="Description of Artificial Sequence: Synthetic polypeptide"
  VARIANT (264)..(264): /replace="A" or "E" or "T" or "G"
  VARIANT (265)..(265): /replace="T" or "A" or "V" or "S"
  VARIANT (266)..(266): /replace="T" or "A" or "V"
  VARIANT (267)..(267): /replace="G" or "D"
  VARIANT (268)..(268): /replace="T"
  VARIANT (272)..(272): /replace="T" or "A"
  VARIANT (383)..(383): /replace="D"
  VARIANT (384)..(384): /replace="T"
  VARIANT (385)..(385): /replace="E"
  VARIANT (386)..(386): /replace="N"
  VARIANT (447)..(447): /replace="N" or "A" or "V" or "R"
  VARIANT (472)..(472): /replace="S" or "A"
  VARIANT (503)..(503): /replace="F"
  VARIANT (504)..(504): /replace="P" or "A"
  VARIANT (529)..(529): /replace="E" or "L"
  VARIANT (530)..(530): /replace="G" or "Q"
  VARIANT (590)..(590): /replace="D" or "A" or "G"
  VARIANT (707)..(707): /replace="D"
  VARIANT (709)..(709): /replace="A" or "T" or "N" or "Q"
  SITE (1)..(736): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNQGGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMRAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTQPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSVNVDFAVNTEGTYSEPRPIGTRYLTRNL

SEQ ID NO: 120 - protein, 736 aa, Artificial Sequence
  source: /note="Description of Artificial Sequence: Synthetic polypeptide"
  VARIANT (264)..(264): /replace="A" or "E" or "T" or "G"
  VARIANT (265)..(265): /replace="T" or "A" or "V" or "S"
  VARIANT (266)..(266): /replace="T" or "A" or "V"
  VARIANT (267)..(267): /replace="G" or "D"
  VARIANT (268)..(268): /replace="T"
  VARIANT (272)..(272): /replace="T" or "A"
  VARIANT (383)..(383): /replace="D"
  VARIANT (384)..(384): /replace="T"
  VARIANT (385)..(385): /replace="E"
  VARIANT (386)..(386): /replace="N"
  VARIANT (447)..(447): /replace="N" or "A" or "V" or "R"
  VARIANT (472)..(472): /replace="S" or "A"
  VARIANT (503)..(503): /replace="F"
  VARIANT (504)..(504): /replace="P" or "A"
  VARIANT (529)..(529): /replace="E" or "L"
  VARIANT (530)..(530): /replace="G" or "Q"
  VARIANT (590)..(590): /replace="D" or "A" or "G"
  VARIANT (707)..(707): /replace="D"
  VARIANT (709)..(709): /replace="A" or "T" or "N" or "Q"
  SITE (1)..(736): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNQGGASNDNHYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTAGTQQLLFSQAGPNNMRAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAQPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSVNVDFAVNTDGTYSEPRPIGTRYLTRNL

SEQ ID NO: 121 - protein, 734 aa, Artificial Sequence
  source: /note="Description of Artificial Sequence: Synthetic polypeptide"
  VARIANT (263)..(263): /replace="A" or "E" or "T" or "G"
  VARIANT (264)..(264): /replace="T" or "A" or "V" or "S"
  VARIANT (265)..(265): /replace="T" or "A" or "V"
  VARIANT (266)..(266): /replace="G" or "D"
  VARIANT (267)..(267): /replace="T"
  VARIANT (271)..(271): /replace="T" or "A"
  VARIANT (382)..(382): /replace="D"
  VARIANT (383)..(383): /replace="T"
  VARIANT (384)..(384): /replace="E"
  VARIANT (385)..(385): /replace="N"
  VARIANT (446)..(446): /replace="N" or "A" or "V" or "R"
  VARIANT (470)..(470): /replace="S" or "A"
  VARIANT (501)..(501): /replace="F"
  VARIANT (502)..(502): /replace="P" or "A"
  VARIANT (527)..(527): /replace="E" or "L"
  VARIANT (528)..(528): /replace="G" or "Q"
  VARIANT (588)..(588): /replace="D" or "A" or "G"
  VARIANT (705)..(705): /replace="D"
  VARIANT (707)..(707): /replace="A" or "T" or "N" or "Q"
  SITE (1)..(734): /note="Variant residues given in the sequence have no preference with respect to those in the annotations for variant positions"
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNQGGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFQFSYEFENVPFHSSYAHSQSLDRLMNPLIDQYLYYLSKTINGSGQNQQTLKFSVAGPSNMRVQGRNYIPGPSYRQQRVSTTVTQNNNSEFAWTGASSWALNGRNSLMNPGPAMASHKDDEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSVNVEFAVNTEGVYSEPRPIGTRYLTRNL

SEQ ID NO: 122 - protein, 734 aa, Artificial Sequence
  source: /note="Description of Artificial Sequence: Synthetic polypeptide"
  VARIANT (263)..(263): /replace="A" or "E" or "T" or "G"
  VARIANT (264)..(264): /replace="T" or "A" or "V" or "S"
  VARIANT (265)..(265): /replace="T" or "A" or "V"
  VARIANT (266)..(266): /replace="G" or "D"
  VARIANT (267)..(267): /replace="T"
  VARIANT (271)..(271): /replace="T" or "A"
  VARIANT (382)..(382): /replace="D"
  VARIANT (383)..(383): /replace="T"
  VARIANT (384)..(384): /replace="E"
  VARIANT (385)..(385): /replace="N"
  VARIANT (446)..(446): /replace="N" or "A" or "V" or "R"
  VARIANT (470)..(470): /replace="S" or "A"
  VARIANT (501)..(501): /replace="F"
  VARIANT (502)..(502): /replace="P" or "A"
  VARIANT (527)..(527): /replace="E" or "L"
  VARIANT (528)..(528): /replace="G" or "Q"
  VARIANT (588)..(588): /replace="D" or "A" or "G"
  VARIANT (705)..(705): /replace="D"
  VARIANT (707)..(707): /replace="A" or "T" or "N" or "Q"
  SITE (1)..(734): /note="Variant residues given in the sequence have no preference with respect to those in the annotations for variant positions"
MAADGYLPDWLEDNLSEGIREWWALKPGAPQPKANQQHQDNARGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSVGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNQGGASNDNHYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNNGSQAVGRSSFYCLEYFPSQMLRTGNNFQFSYEFENVPFHSSYAHSQSLDRLMNPLIDQYLYYLSKTINGSGQNQQTLKFSVAGPSNMRVQGRNYIPGPSYRQQRVSTTVTQNNNSEFAWTGASSWALNGRNSLMNPGPAMASHKDDEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSVNVEFAVNTEGVYSEPRPIGTRYLTRNL

SEQ ID NO: 123 - protein, 736 aa, Artificial Sequence
  source: /note="Description of Artificial Sequence: Synthetic polypeptide"
  VARIANT (264)..(264): /replace="A" or "E" or "T" or "G"
  VARIANT (265)..(265): /replace="T" or "A" or "V" or "S"
  VARIANT (266)..(266): /replace="T" or "A" or "V"
  VARIANT (267)..(267): /replace="G" or "D"
  VARIANT (268)..(268): /replace="T"
  VARIANT (272)..(272): /replace="T" or "A"
  VARIANT (383)..(383): /replace="D"
  VARIANT (384)..(384): /replace="T"
  VARIANT (385)..(385): /replace="E"
  VARIANT (386)..(386): /replace="N"
  VARIANT (447)..(447): /replace="N" or "A" or "V" or "R"
  VARIANT (472)..(472): /replace="S" or "A"
  VARIANT (503)..(503): /replace="F"
  VARIANT (504)..(504): /replace="P" or "A"
  VARIANT (529)..(529): /replace="E" or "L"
  VARIANT (530)..(530): /replace="G" or "Q"
  VARIANT (590)..(590): /replace="D" or "A" or "G"
  VARIANT (707)..(707): /replace="D"
  VARIANT (709)..(709): /replace="A" or "T" or "N" or "Q"
  SITE (1)..(736): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGESESVPDPQPIGEPPAGPSGLGSGTMAAGGGAPMADNNEGADGVGSSSGNWHCDSTWLGDRVITTSTRTWALPTYNNHLYKQISNQGGASNDNHYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMRAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTQPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSVNVDFAVNTEGTYSEPRPIGTRYLTRNL

SEQ ID NO: 124 - protein, 723 aa, Artificial Sequence
  source: /note="Description of Artificial Sequence: Synthetic polypeptide"
  VARIANT (253)..(253): /replace="A" or "E" or "T" or "G"
  VARIANT (254)..(254): /replace="T" or "A" or "V" or "S"
  VARIANT (255)..(255): /replace="T" or "A" or "V"
  VARIANT (256)..(256): /replace="G" or "D"
  VARIANT (257)..(257): /replace="T"
  VARIANT (261)..(261): /replace="T" or "A"
  VARIANT (374)..(374): /replace="D"
  VARIANT (375)..(375): /replace="T"
  VARIANT (376)..(376): /replace="E"
  VARIANT (377)..(377): /replace="N"
  VARIANT (438)..(438): /replace="N" or "A" or "V" or "R"
  VARIANT (457)..(457): /replace="S" or "A"
  VARIANT (488)..(488): /replace="F"
  VARIANT (489)..(489): /replace="P" or "A"
  VARIANT (514)..(514): /replace="E" or "L"
  VARIANT (515)..(515): /replace="G" or "Q"
  VARIANT (578)..(578): /replace="D" or "A" or "G"
  VARIANT (694)..(694): /replace="D"
  VARIANT (696)..(696): /replace="A" or "T" or "N" or "Q"
  SITE (1)..(723): /note="Variant residues given in the sequence have no preference with respect to those in the annotations for variant positions"
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSQGGASNANHYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNGSQPTERSSFFCLEYFPSKMLRTGNNFEFTYNFEEVPFHSSFAPSQNLFKLANPLVDQYLYRFSSTNNTGGVQFNKNLAGRYRNTYKNWFPGPMGRTQGWNLGSGVNRASVSAWTTTNRMELEGASYQVPPQPNGMTNNDDGSNTYALENTMIFNSQPANPGTTATYLEGNMLITSESETQPVNRVAYNVGGQMATNNQSSTTQPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNKPVFVDFAPDSTGEYRTTRPIGTRYLTRPL

SEQ ID NO: 125 - protein, 735 aa, Artificial Sequence
  source: /note="Description of Artificial Sequence: Synthetic polypeptide"
  VARIANT (446)..(446): /replace="S"
  VARIANT (471)..(471): /replace="R" or "S"
  VARIANT (708)..(708): /replace="V" or "A"
  SITE (1)..(735): /note="Variant residues given in the sequence have no preference with respect to those in the annotations for variant positions"
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLRRTNTPSGTTTQSRLQFSQAGASDIADQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSTNVDFTVDTNGVYSEPRPIGTRYLTRNL

SEQ ID NO: 126 - protein, 735 aa, Artificial Sequence
  source: /note="Description of Artificial Sequence: Synthetic polypeptide"
  VARIANT (446)..(446): /replace="S"
  VARIANT (471)..(471): /replace="R" or "S"
  VARIANT (708)..(708): /replace="V" or "A"
  SITE (1)..(735): /note="Variant residues given in the sequence have no preference with respect to those in the annotations for variant positions"
AADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLRRTQNQSGSAQNKDLLFSRGSPAGMAVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSTNVDFTVDNNGLYTEPRPIGTRYLTRPL

SEQ ID NO: 127 - protein, 736 aa, Artificial Sequence
  source: /note="Description of Artificial Sequence: Synthetic polypeptide"
  VARIANT (447)..(447): /replace="S"
  VARIANT (472)..(472): /replace="R" or "S"
  VARIANT (709)..(709): /replace="V" or "A"
  SITE (1)..(736): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLRRTQNQSGSAQNKDLLFSRGSPAGMAVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSTNVDFTVDNNGLYTEPRPIGTRYLTRPL

SEQ ID NO: 128 - protein, 736 aa, Artificial Sequence
  source: /note="Description of Artificial Sequence: Synthetic polypeptide"
  VARIANT (446)..(446): /replace="S"
  VARIANT (472)..(472): /replace="R" or "S"
  VARIANT (709)..(709): /replace="V" or "A"
  SITE (1)..(736): /note="Variant residues given in the sequence have no preference with respect to those in the annotations for variant positions"
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLRRTQGTTSGTTNQSRLLFSQAGPQSMALQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSTNVDFTVDTNGVYSEPRPIGTRYLTRNL

SEQ ID NO: 129 - protein, 736 aa, Artificial Sequence
  source: /note="Description of Artificial Sequence: Synthetic polypeptide"
  VARIANT (446)..(446): /replace="S"
  VARIANT (472)..(472): /replace="R" or "S"
  VARIANT (709)..(709): /replace="V" or "A"
  SITE (1)..(736): /note="Variant residues given in the sequence have no preference with respect to those in the annotations for variant positions"
MAADGYLPDWLEDNLSEGIREWWALQPGAPKPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLRRTQGTTSGTTNQSRLLFSQAGPQSMALQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTRTVNDQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSTNVDFTVDTNGVYSEPRPIGTRYLTRPL

SEQ ID NO: 130 - protein, 737 aa, Artificial Sequence
  source: /note="Description of Artificial Sequence: Synthetic polypeptide"
  VARIANT (448)..(448): /replace="S"
  VARIANT (474)..(474): /replace="R" or "S"
  VARIANT (710)..(710): /replace="V" or "A"
  SITE (1)..(737): /note="Variant residues given in the sequence have no preference with respect to those in the annotations for variant positions"
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLRRTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 131 - protein, 737 aa, Artificial Sequence
  source: /note="Description of Artificial Sequence: Synthetic polypeptide"
  VARIANT (448)..(448): /replace="S"
  VARIANT (473)..(473): /replace="R" or "S"
  VARIANT (710)..(710): /replace="V" or "A"
  SITE (1)..(737): /note="Variant residues given in the sequence have no preference with respect to those in the annotations for variant positions"
AADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLRRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 132 - protein, 738 aa, Artificial Sequence
  source: /note="Description of Artificial Sequence: Synthetic polypeptide"
  VARIANT (449)..(449): /replace="S"
  VARIANT (474)..(474): /replace="R" or "S"
  VARIANT (711)..(711): /replace="V" or "A"
  SITE (1)..(738): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLRRTQSTGGTQGTQQLLFSQAGPANMAAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 133 - protein, 738 aa, Artificial Sequence
  source: /note="Description of Artificial Sequence: Synthetic polypeptide"
  VARIANT (449)..(449): /replace="S"
  VARIANT (474)..(474): /replace="R" or "S"
  VARIANT (711)..(711): /replace="V" or "A"
  SITE (1)..(738): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLRRTQSTGGTAGTQQLLFSQAGPNNMAAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTDGTYSEPRPIGTRYLTRNL

SEQ ID NO: 134 - protein, 736 aa, Artificial Sequence
  source: /note="Description of Artificial Sequence: Synthetic polypeptide"
  VARIANT (448)..(448): /replace="S"
  VARIANT (472)..(472): /replace="R" or "S"
  VARIANT (709)..(709): /replace="V" or "A"
  SITE (1)..(736): /note="Variant residues given in the sequence have no preference with respect to those in the annotations for variant positions"
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLRKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTNVEFAVNTEGVYSEPRPIGTRYLTRNL

SEQ ID NO: 135 - protein, 736 aa, Artificial Sequence
  source: /note="Description of Artificial Sequence: Synthetic polypeptide"
  VARIANT (448)..(448): /replace="S"
  VARIANT (472)..(472): /replace="R" or "S"
  VARIANT (709)..(709): /replace="V" or "A"
  SITE (1)..(736): /note="Variant residues given in the sequence have no preference with respect to those in the annotations for variant positions"
MAADGYLPDWLEDNLSEGIREWWALKPGAPQPKANQQHQDNARGLVLPGYKYLGPGNGLDKGEPVNEADAAALEHDKAYDQQLKAGDNPYLKYNHADAEFQERLKEDTSFGGNLGRAVFQAKKRLLEPLGLVEEAAKTAPGKKRPVEQSPQEPDSSVGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLRKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSTNVEFAVNTEGVYSEPRPIGTRYLTRNL

SEQ ID NO: 136 - protein, 738 aa, Artificial Sequence
  source: /note="Description of Artificial Sequence: Synthetic polypeptide"
  VARIANT (449)..(449): /replace="S"
  VARIANT (474)..(474): /replace="R" or "S"
  VARIANT (711)..(711): /replace="V" or "A"
  SITE (1)..(738): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGESESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLRRTQSTGGTQGTQQLLFSQAGPANMAAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 137 - protein, 724 aa, Artificial Sequence
  source: /note="Description of Artificial Sequence: Synthetic polypeptide"
  VARIANT (439)..(439): /replace="S"
  VARIANT (458)..(458): /replace="R" or "S"
  VARIANT (697)..(697): /replace="V" or "A"
  SITE (1)..(724): /note="Variant residues given in the sequence have no preference with respect to those in the annotations for variant positions"
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFRSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPTFVDFAPDSTGEYRTTRPIGTRYLTRPL

SEQ ID NO: 138 - protein, 736 aa, Artificial Sequence; identical to SEQ ID NO: 109
  source: /note="Description of Artificial Sequence: Synthetic polypeptide"
  VARIANT (168)..(168): /replace="R"
  VARIANT (204)..(204): /replace="S"
  VARIANT (266)..(266): /replace="G"
  VARIANT (311)..(311): /replace="K"
  VARIANT (411)..(411): /replace="Q"
  VARIANT (460)..(460): /replace="E"
  VARIANT (493)..(493): /replace="T"
  VARIANT (562)..(562): /replace="N"
  VARIANT (576)..(576): /replace="E"
  VARIANT (587)..(587): /replace="A"
  VARIANT (609)..(609): /replace="D"
  SITE (1)..(736): /note="Variant residues given in the sequence have no preference with respect to those in the annotations for variant positions"

SEQ ID NO: 139 - protein, 737 aa, Artificial Sequence
  source: /note="Description of Artificial Sequence: Synthetic polypeptide"
  VARIANT (157)..(157): /replace="S"
  VARIANT (168)..(168): /replace="R"
  VARIANT (262)..(262): /replace="S"
  VARIANT (263)..(263): /replace="H"
  VARIANT (312)..(312): /replace="K"
  VARIANT (412)..(412): /replace="Q"
  VARIANT (460)..(460): /replace="Q"
  VARIANT (461)..(461): /replace="E"
  VARIANT (552)..(552): /replace="S"
  VARIANT (556)..(556): /replace="Y"
  VARIANT (557)..(557): /replace="S"
  VARIANT (563)..(563): /replace="N"
  VARIANT (580)..(580): /replace="I"
  VARIANT (588)..(588): /replace="S"
  VARIANT (664)..(664): /replace="T"
  SITE (1)..(737): /note="Variant residues given in the sequence have no preference with respect to those in the annotations for variant positions"
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSTGIGKKGQQPAKKRLNFGQTGDSESVPDPQPLGEPPAAPSGVGSNTMAAGGGAPMADNNEGADGVGNASGNWHCDSTWLGDRVITTSTRTWALPTYNNHLYKQISNSQSGGSTNDNTYFGYSTPWGYFDFNRFHCHFSPRDWQRLINNNWGFRPKRLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQTTGGTAGNRTLQFSQAGPSSMANQAKNWLPGPCYRQQRVSKTTNQNNNSNFAWTGATKYHLNGRDSLVNPGVAMATHKDDEDRFFPSSGVLIFGKQGAGNDNVDLDNVMITSEEEIKTTNPVATEEYGVVATNLQSNNTAPQTGTVNSQGALPGMVWQNRDVYLQGPIWAKIPHTDGNFHPSPLMGGFGLKHPPPQILIKNTPVPANPPTTFSPAKFASFITQYSTGQVSVEIEWELQKENSKRWNPEIQYTSNYNKSTNVDFAVDTEGVYSEPRPIGTRYLTRNL

SEQ ID NO: 140 - protein, 738 aa, Artificial Sequence; identical to SEQ ID NO: 94
  source: /note="Description of Artificial Sequence: Synthetic polypeptide"
  VARIANT (158)..(158): /replace="S"
  VARIANT (169)..(169): /replace="R"
  VARIANT (564)..(564): /replace="N"
  SITE (1)..(738): /note="Variant residues given in the sequence have no preference with respect to those in the annotations for variant positions"

SEQ ID NO: 141 - protein, 738 aa, Artificial Sequence; identical to SEQ ID NO: 95
  source: /note="Description of Artificial Sequence: Synthetic polypeptide"
  VARIANT (158)..(158): /replace="S"
  VARIANT (169)..(169): /replace="K"
  VARIANT (315)..(315): /replace="S"
  VARIANT (413)..(413): /replace="E"
  VARIANT (472)..(472): /replace="T" or "S"
  VARIANT (534)..(534): /replace="E"
  VARIANT (542)..(542): /replace="V"
  VARIANT (595)..(595): /replace="V"
  SITE (1)..(738): /note="Variant residues given in the sequence have no preference with respect to those in the annotations for variant positions"

SEQ ID NO: 142 - protein, 738 aa, Artificial Sequence; identical to SEQ ID NO: 96
  source: /note="Description of Artificial Sequence: Synthetic polypeptide"
  VARIANT (169)..(169): /replace="K"
  VARIANT (315)..(315): /replace="S"
  VARIANT (534)..(534): /replace="E"
  VARIANT (542)..(542): /replace="V"
  SITE (1)..(738): /note="Variant residues given in the sequence have no preference with respect to those in the annotations for variant positions"

SEQ ID NO: 143 - protein, 738 aa, Artificial Sequence; identical to SEQ ID NO: 97
  source: /note="Description of Artificial Sequence: Synthetic polypeptide"
  VARIANT (471)..(471): /replace="N"
  SITE (1)..(738): /note="Variant residues given in the sequence have no preference with respect to those in the annotations for variant positions"

SEQ ID NO: 144 - protein, 737 aa, Artificial Sequence; identical to SEQ ID NO: 98
  source: /note="Description of Artificial Sequence: Synthetic polypeptide"
  VARIANT (148)..(148): /replace="Q"
  VARIANT (169)..(169): /replace="R"
  VARIANT (314)..(314): /replace="N"
  VARIANT (466)..(466): /replace="H"
  VARIANT (563)..(563): /replace="S"
  VARIANT (580)..(580): /replace="I"
  VARIANT (588)..(588): /replace="S"
  SITE (1)..(737): /note="Variant residues given in the sequence have no preference with respect to those in the annotations for variant positions"

SEQ ID NO: 145 - protein, 735 aa, Artificial Sequence; identical to SEQ ID NO: 99
  source: /note="Description of Artificial Sequence: Synthetic polypeptide"
  VARIANT (162)..(162): /replace="T"
  VARIANT (168)..(168): /replace="R"
  VARIANT (224)..(224): /replace="S"
  VARIANT (310)..(310): /replace="K"
  VARIANT (410)..(410): /replace="Q"
  VARIANT (446)..(446): /replace="N"
  VARIANT (461)..(461): /replace="L"
  VARIANT (471)..(471): /replace="S"
  VARIANT (708)..(708): /replace="T"
  SITE (1)..(735): /note="Variant residues given in the sequence have no preference with respect to those in the annotations for variant positions"

SEQ ID NO: 146 - protein, 735 aa, Artificial Sequence; identical to SEQ ID NO: 100
  source: /note="Description of Artificial Sequence: Synthetic polypeptide"
  VARIANT (42)..(42): /replace="S"
  VARIANT (168)..(168): /replace="K"
  VARIANT (310)..(310): /replace="R"
  VARIANT (410)..(410): /replace="Q"
  VARIANT (446)..(446): /replace="R"
  VARIANT (461)..(461): /replace="L"
  VARIANT (471)..(471): /replace="S"
  VARIANT (475)..(475): /replace="R"
  VARIANT (504)..(504): /replace="A"
  VARIANT (539)..(539): /replace="N"
  SITE (1)..(735): /note="Variant residues given in the sequence have no preference with respect to those in the annotations for variant positions"

SEQ ID NO: 147 - DNA, 2208 bp, Artificial Sequence
  source: /note="Description of Artificial Sequence: Synthetic polynucleotide"
  variation (502)..(504): /replace="aaa"
  variation (610)..(612): /replace="agc"
  variation (796)..(798): /replace="ggc"
  variation (931)..(933): /replace="aag"
  variation (1231)..(1233): /replace="cag"
  variation (1378)..(1380): /replace="gag"
  variation (1477)..(1479): /replace="acc"
  variation (1684)..(1686): /replace="aac"
  variation (1726)..(1728): /replace="gag"
  variation (1759)..(1761): /replace="gcc"
  variation (1825)..(1827): /replace="gac"
  misc_feature (1)..(2208): /note="Variant nucleotides given in the sequence have no preference with respect to those in the annotations for variant positions"
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcaatcaccccaggaaccagactcctcttcgggcatcggcaagaaaggccagcagcccgcgaagaagagactcaactttgggcagacaggcgactcagagtcagtgcccgaccctcaaccactcggagaaccccccgcagccccctctggtgtgggatctaatacaatggcagcaggcggtggcgctccaatggcagacaataacgaaggcgccgacggagtgggtaacgcctcaggaaattggcattgcgattccacatggctgggcgacagagtcatcaccaccagcacccgaacctgggccctccccacctacaacaaccacctctacaagcaaatctccagccaatcgggagcaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgacgaatgatggcaccacgaccatcgccaataaccttaccagcacggttcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctacacgtttgaggacgtgccttttcacagcagctacgcgcacagccaaagcctggaccggctgatgaaccccctcatcgaccagtacctgtactacctgtctcggactcagaccacgagtggtaccgcaggaaatcggacgttgcaattttctcaggccgggcctagtagcatggcgaatcaggccaaaaactggctacccgggccctgctaccggcagcaacgcgtctccaagacagcgaatcaaaataacaacagcaactttgcctggaccggtgccaccaagtatcatctgaatggcagagactctctggtaaatcccggtcccgctatggcaacccacaaggacgacgaagacaaattttttccgatgagcggagtcttaatatttgggaaacagggagctggaaatagcaacgtggaccttgacaacgttatgataaccagtgaggaagaaattaaaaccaccaacccagtggccacagaacagtacggcacggtggccactaacctgcaatcgtcaaacaccgctcctgctacagggaccgtcaacagtcaaggagccttacctggcatggtctggcagaaccgggacgtgtacctgcagggtcctatctgggccaagattcctcacacggacggacactttcatccctcgccgctgatgggaggctttggactgaaacacccgcctcctcagatcctgattaagaatacacctgttcccgcgaatcctccaactaccttcagtccagctaagtttgcgtcgttcatcacgcagtacagcaccggacaggtcagcgtggaaattgaatgggagctgcagaaagaaaacagcaaacgctggaacccagagattcaatacacttccaactacaacaaatctacaaatgtggactttgctgttgacacaaatggcgtttattctgagcctcgccccatcggcacccgttacctcacccgtaatctg

SEQ ID NO: 148 - DNA, 2211 bp, Artificial Sequence
  source: /note="Description of Artificial Sequence: Synthetic polynucleotide"
  variation (470)..(469): /replace="agc"
  variation (502)..(504): /replace="aag"
  variation (784)..(786): /replace="agt"
  variation (787)..(789): /replace="cac"
  variation (934)..(936): /replace="aag"
  variation (1234)..(1236): /replace="cag"
  variation (1378)..(1380): /replace="cag"
  variation (1381)..(1383): /replace="gag"
  variation (1654)..(1656): /replace="agc"
  variation (1666)..(1668): /replace="tac"
  variation (1669)..(1671): /replace="agc"
  variation (1687)..(1689): /replace="aac"
  variation (1738)..(1740): /replace="atc"
  variation (1762)..(1764): /replace="agc"
  variation (1990)..(1992): /replace="acc"
  misc_feature (1)..(2211): /note="Variant nucleotides given in the sequence have no preference with respect to those in the annotations for variant positions"
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagcaatcaccccaggaaccagactcctctacgggcatcggcaagaaaggccagcagcccgcgaaaaagagactcaactttgggcagactggcgactcagagtcagtgcccgaccctcaaccactcggagaaccccccgcagccccctctggtgtgggatctaatacaatggctgcaggcggtggcgctccaatggcagacaataacgaaggcgccgacggagtgggtaatgcctcaggaaattggcattgcgattccacatggctgggcgacagagtcatcaccaccagcacccgaacctgggccctccccacctacaacaaccacctctacaagcaaatctccaacagccaatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgacgaatgatggcaccacgaccatcgccaataaccttaccagcacggttcaggtctttacggactcggaataccagctcccgtacgtcctcggctctgcgcaccagggctgcctgcctccgttcccggcggacgtcttcatgattcctcagtacgggtacctgactctgaacaatggcagtcaggccgtgggccgttcctccttctactgcctggagtactttccttctcaaatgctgagaacgggcaacaactttgagttcagctacacgtttgaggacgtgccttttcacagcagctacgcgcacagccaaagcctggaccggctgatgaaccccctcatcgaccagtacctgtactacctgtctcggactcagaccacgggaggtaccgcaggaaatcggacgttgcaattttctcaggccgggcctagtagcatggcgaatcaggccaaaaactggctacccgggccctgctaccggcagcaacgcgtctccaagacaacgaatcaaaataacaacagcaactttgcctggaccggtgccaccaagtatcatctgaatggcagagactctctggtaaatcccggtgtcgctatggcaacccacaaggacgacgaagaccgattttttccgtccagcggagtcttaatatttgggaaacagggagctggaaatgacaacgtggaccttgacaacgttatgataaccagtgaggaagaaattaaaaccaccaacccagtggccacagaagagtacggcgtggtggccactaacctgcaatcggcaaacaccgctcctcaaacagggaccgtcaacagtcaaggagccttacctggcatggtctggcagaaccgggacgtgtacctgcagggtcctatctgggccaagattcctcacacggacggaaactttcatccctcgccgctgatgggaggctttggactgaaacacccgcctcctcagatcctgattaagaatacacctgttcccgcgaatcctccaactaccttcagtccagctaagtttgcgtcgttcatcacgcagtacagcaccggacaggtcagcgtggaaattgaatgggagctgcagaaagaaaacagcaaacgctggaacccagagattcaatacacttccaactacaacaaatctacaaatgtggactttgctgttgacacagaaggcgtttattctgagcctcgccccatcggcacccgttacctcacccgtaatctg

SEQ ID NO: 149 - DNA, 2211 bp, Artificial Sequence
  source: /note="Description of Artificial Sequence: Synthetic polynucleotide"
  variation (470)..(469): /replace="acg"
  variation (502)..(504): /replace="aga"
  variation (1366)..(1368): /replace="gga"
  variation (1384)..(1386): /replace="gca"
  variation (1519)..(1521): /replace="gcc"
  variation (1525)..(1527): /replace="ttt"
  variation (1528)..(1530): /replace="aaa"
  variation (1669)..(1671): /replace="aac"
  variation (1750)..(1752): /replace="cac"
  variation (1756)..(1758): /replace="gcc"
  misc_feature (1)..(2211): /note="Variant nucleotides given in the sequence have no preference with respect to those in the annotations for variant positions"
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaagcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagaggccggtagagcagtcgccacaagagccagactcctcctcgggcatcggcaagacaggccagcagcccgctaaaaagagactcaattttggtcagactggcgactcagagtcagtccccgacccacaacctctcggagaacctccagcagccccctcaggtgtgggatctaatacaatggcttcaggcggtggcgctccaatggcagacaataacgaaggcgccgacggagtgggtaattcctcgggaaattggcattgcgattccacatggctgggggacagagtcatcaccaccagcacccgaacctgggccctgcccacctacaacaaccacctctacaagcaaatctccaacggcacctcgggaggaagcaccaacgacaacacctattttggctacagcaccccctgggggtattttgacttcaacagattccactgtcacttttcaccacgtgactggcaacgactcatcaacaacaattggggattccggcccaaaagactcaacttcaagctgttcaacatccaggtcaaggaagtcacgacgaacgaaggcaccaagaccatcgccaataatctcaccagcaccgtgcaggtctttacggactcggagtaccagttaccgtacgtgctaggatccgctcaccagggatgtctgcctccgttcccggcggacgtcttcatgattcctcagtacggctatttaactttaaacaatggaagccaagccgtgggacgttcctccttctactgtctggagtatttcccatcgcagatgctgagaaccggcaacaactttcagttcagctacaccttcgaggacgtgcctttccacagcagctacgcgcacagccagagcctggacaggctgatgaatcccctcatcgaccagtacctgtactacctgtccagaacgcaaacgactggaactgcagggacgcagactctgcaattcagccaagcgggtcctagctcaatggccaaccaggctagaaattgggtgcccggaccttgctaccggcagcagcgcgtctccacgacaaccaaccagaacaacaacagcaactttgcctggacgggagctaccaagtatcacctgaacggccgagactctctaatgaatccgggcgtggcaatggcttcccacaaggatgacgaggaccgcttcttcccttcgagcggggtcctgatttttggcaagcaaggagccgggaacgataatgtggattacagccaagtgatgattacaaatgaggaagaaatcaagactaccaaccccgtggccacagaagaatatggagcagtggccaccaacaaccagtccgccaatacgcaggcgcagaccggactcgtgcacaaccagggggtgcttcccggcatggtgtggcagaatagagacgtgtacctgcagggtcccatctgggccaaaattcctcacacggacggcaactttcacccgtctcccctgatgggcggctttggactgaagcacccgcctcctcaaattctcatcaagaacacaccggttccagcggacccgccgactaccttcaaccaggccaagctgaactctttcatcacgcagtacagcaccggacaggtcagcgtggaaatcgagtgggagctgcagaaagaaaacagcaaacgctggaatccagagattcaatacacttccaactactacaaatctacaaatgtggactttgctgtcaacacggagggggtttatagcgagcctcgccccattggcacccgttacctcacccgcaacctgtaa

SEQ ID NO: 150 - DNA, 2205 bp, Artificial Sequence
  source: /note="Description of Artificial Sequence: Synthetic polynucleotide"
  variation (485)..(484): /replace="aca"
  variation (502)..(504): /replace="aga"
  variation (670)..(672): /replace="tcc"
  variation (928)..(930): /replace="aaa"
  variation (1228)..(1230): /replace="cag"
  variation (1336)..(1338): /replace="aac"
  variation (1381)..(1383): /replace="ctg"
  variation (1411)..(1413): /replace="tct"
  variation (2122)..(2124): /replace="acc"
  misc_feature (1)..(2205): /note="Variant nucleotides given in the sequence have no preference with respect to those in the annotations for variant positions"
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaacctcttggtctggttgaggaaggtgctaagacggctcctggaaagaaacgtccggtagagcagtcgccacaagagccagactcctcctcgggcattggcaagtcaggccagcagcccgctaaaaagagactcaattttggtcagactggcgactcagagtcagtccccgacccacaacctctcggagaacctccagcagccccctctggtgtgggatctaatacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtcaatcaggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcaccacgaccatcgctaataaccttaccagcacggttcaagtcttcacggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgagcagaactcagactacgtccggaactgcccaaaacagggagttgcagtttagccaggcgggtccatctagcatggctaatcaggccaaaaactggctacctggaccctgttaccggcagcagcgcgtttctaaaacagcaaatgacaacaacaacagcaactttgcctggactggtgctacaaaatatcaccttaatgggcgtgattctttagtcaaccctggccctgctatggcctcacacaaagacgacgaagacaagttctttcccatgagcggtgtcttgatttttggaaagcagggcgccggagcttcaaacgttgatttggacaatgtcatgatcacagacgaagaggaaatcaaaaccactaaccccgtggccaccgaacaatatgggactgtggcaaccaatctccagagcagcaacacagcccctgcgaccggaactgtgaattctcagggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccgacaacgttttcgcctgcaaagtttgcttcattcatcacccagtattccacaggacaagtgagcgtggagattgaatgggagctgcagaaagaaaacagcaaacgctggaatcccgaaatacagtatacatctaactataataaatctgccaacgttgatttcactgtggacaccaatggagtttatagtgagcctcgccccattggcacccgttacctcacccgtaacctg

SEQ ID NO: 151 - DNA, 2205 bp, Artificial Sequence
  source: /note="Description of Artificial Sequence: Synthetic polynucleotide"
  variation (125)..(124): /replace="agt"
  variation (502)..(504): /replace="aaa"
  variation (928)..(930): /replace="aga"
  variation (1228)..(1230): /replace="cag"
  variation (1336)..(1338): /replace="aga"
  variation (1381)..(1383): /replace="ctc"
  variation (1411)..(1413): /replace="tct"
  variation (1423)..(1425): /replace="aga"
  variation (1510)..(1512): /replace="gcg"
  variation (1615)..(1617): /replace="gac"
  misc_feature (1)..(2205): /note="Variant nucleotides given in the sequence have no preference with respect to those in the annotations for variant positions"
atggctgctgacggttatcttccagattggctcgaggacaacctttctgaaggcattcgtgagtggtgggatctgaaacctggagcccctcaacccaaagcgaaccaacaacaccaggacgacggtcggggtcttgtgcttccgggttacaaatacctcggaccctttaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagagggtccttgagcctcttggtctggttgaggaagcagctaaaacggctcctggaaagaagaggcctgtagaacagtctcctcaggaaccggactcatcatctggtattggcaaatcgggccaacagcctgccagaaaaagactaaatttcggtcagactggagactcagagtcagtcccagaccctcaacctctcggagaaccaccagcagccccctcaggtgtgggatctaatacaatggcttcaggcggtggcgcaccaatggcagacaataacgagggtgccgatggagtgggtaattcctcaggaaattggcattgcgattccacatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcaacttcaagctcttcaacatccaagttaaagaggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatgatccctcagtatggatacctcaccctgaacaacggaagtcaagcggtgggacgctcatccttttactgcctggagtacttcccttcgcagatgctaaggactggaaataacttcacattcagctataccttcgaggatgtaccttttcacagcagctacgctcacagccagagtttggatcgcttgatgaatcctcttattgatcagtatctgtactacctgagcagaacgcaaacaacctctggaacaacccaacaatcacggctgcaatttagccaggctgggccttcgtctatggctcagcaggccaaaaattggctacctgggccctgctaccggcaacagagagtttcaaagactgctaacgacaacaacaacagtaactttgcttggacaggggccaccaaatatcatctcaatggccgcgactcgctggtgaatccaggaccagctatggccagtcacaaggacgatgaagaaaaatttttccctatgcacggcgttctaatatttggcaaacaagggacaggggcaagtaacgtagatttagataatgtaatgattacggatgaagaagagattcgtaccaccaatcctgtggcaacagagcagtatggaactgtggcaactaacttgcagagctcaaatacagctcccgcgactggaactgtcaatagtcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcttgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttg

SEQ ID NO: 152 - DNA, 2208 bp, Artificial Sequence
  source: /note="Description of Artificial Sequence: Synthetic polynucleotide"
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 153 - protein, 549 aa, Adeno-associated virus
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTG

SEQ ID NO: 154 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANSLTSTIQVFTDSEYQLPYVLGSAHQGCLPPFPADVFMIPQYGYLTPNNGSQAVGRSSFYCLEYFPSQMLRTGNNFSFSYTFEDVPFHSSYAHSQSLDRLMNPLIDQYLYYLSRTQSTGGTAGTQQLLSSQAGPSNMSAQARNWLPGPCYRQQRVSTTLSQNNNSNFAWTGATKYHLNGRDSLVNPGVAMATNKDDEDRFFPSSGILMFGKQG

SEQ ID NO: 155 - protein, 549 aa, Adeno-associated virus
MVADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAELQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCQPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQG

SEQ ID NO: 156 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGRTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYLDFNRFHCHFSPRDWQRLINNNWGFRPKRLSFKLFNIQVKEVTQNEGTKTIANNLASTIQVFTDSEYQPPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSRAGPSNMSAQARNWLPGPCYRQQRVSTTLSQNNNSNFAWTGATKYHLNGRDSLVNPGVAMATNKDDEDRFFPSSGILMFGKQG

SEQ ID NO: 157 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYVHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNSGVAMATNKDDEDRFFPSSGILMFGKQG

SEQ ID NO: 158 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQG

SEQ ID NO: 159 - protein, 547 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLEAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPVTGSCFWQQN

SEQ ID NO: 160 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAGKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLVDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQG

SEQ ID NO: 161 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPHLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQLIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGNLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQG

SEQ ID NO: 162 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRPINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYPFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQG

SEQ ID NO: 163 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGPVEEAAKTAPGKKRPVEPPPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTVANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQG

SEQ ID NO: 164 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQG

SEQ ID NO: 165 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQSNNSNFAWTGATKYHLNGRDSLVNPGVAMATHKDDEERFFPSSGVLMFGKQG

SEQ ID NO: 166 - protein, 549 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQTSNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQG

SEQ ID NO: 167 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQDEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSARAKNWLPGPCYRQQRVSTTLSQNNNSNFAWTGATKYHLNGRDSLVNPGVAMATHKDDEERFFPSSGVLMFGKQG

SEQ ID NO: 168 - protein, 549 aa, Adeno-associated virus
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQN

SEQ ID NO: 169 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQG

SEQ ID NO: 170 - protein, 549 aa, Adeno-associated virus; identical to SEQ ID NO: 167

SEQ ID NO: 171 - protein, 549 aa, Adeno-associated virus
MAADGYLPDWLEDNLSEGIREWWDLKPGAPKPKANQQKQDDGRGLVLLGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSGYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQG

SEQ ID NO: 172 - protein, 549 aa, Adeno-associated virus
MAADGYLPDWLEDNLSEGIREWWDLKPGAPKPKANQQKQDDGRGLVLPGCKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQG

SEQ ID NO: 173 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSAWLGDRVITTSTRPWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQG

SEQ ID NO: 174 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSAGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTETIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSCAHSQSSDRLMNPLIDQYLYYLSRTRSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQG

SEQ ID NO: 175 - protein, 549 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQRPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKPFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLHYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQG

SEQ ID NO: 176 - protein, 547 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQG

SEQ ID NO: 177 - protein, 547 aa, Adeno-associated virus
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQG

SEQ ID NO: 178 - protein, 547 aa, Adeno-associated virus
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGGQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQG

SEQ ID NO: 179 - protein, 603 aa, Adeno-associated virus
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYL

SEQ ID NO: 180 - protein, 122 aa, Adeno-associated virus
QGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 181 - protein, 122 aa, Adeno-associated virus
QGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 182 - protein, 122 aa, Adeno-associated virus
QGPIWAKIPHTDGNFHPSPLMGGFGLKHPPPQILIKNTPVPADPPTAFNQAKLNSFITQYSTGQVSVEIEWEPQKENSKRWNPEIQYTSNYYKSTNVDFAVNTEGVYSEPRPIGTRYLTRNL

SEQ ID NO: 183 - protein, 122 aa, Adeno-associated virus
QGPIWAKIPHTDGNFHPSPLMGGFGLKHPPPQILIKNTPVPADPPTAFNQAKLNSFIAQYSTGQVSVEIEWELQKENSKRWNPEIQYTSNYYKSTNADFAVNTEGVYSEPRPIGTRYLTRNL

SEQ ID NO: 184 - protein, 122 aa, Adeno-associated virus
QGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYPTRNL

SEQ ID NO: 185 - protein, 122 aa, Adeno-associated virus
QGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 186 - protein, 122 aa, Adeno-associated virus
QGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 187 - protein, 122 aa, Adeno-associated virus
QGPIWAKIPHTDGNFHPSPLMGGFGLKHPPPQILIKNTPVPADPPTAFNQAKLNSFITQYSTGQVSVEIEWELQKENSKRWSPEIQYTSNYYKSTNVDFAVNTEGVYSEPRPIGTRYLTRNL

SEQ ID NO: 188 - protein, 122 aa, Adeno-associated virus
QGPIWAKIPHTDGNFHPSPLMGGFGLKHPPPQILIKNTPVPADPPTAFNQAKLNSFITQYGTGQVSVEIEWELQKENSKRWNPEIQYTSNYYKSTNVDFAVNTEGVYSEPRPIGTRYLTRNL

SEQ ID NO: 189 - protein, 122 aa, Adeno-associated virus
QGPIWAKIPHTDGNFHPSPLMGGFGLKHPPPQVLIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 190 - protein, 122 aa, Adeno-associated virus; identical to SEQ ID NO: 185

SEQ ID NO: 191 - protein, 122 aa, Adeno-associated virus
QGPIWAKIPHTDGNFHPSPLMGGFGLKHPPPQILIKNTPVPADPPTAFNQAKLNSFITQYSTGQVSVEIVWELQKENSKRRNPEIQYTSNYYKSTNVDFAVNTEGVYSEPRPIGTRYLTRNL

SEQ ID NO: 192 - protein, 122 aa, Adeno-associated virus
QGPIWAKIPHTDGNFHPSPLMGGLGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 193 - protein, 122 aa, Adeno-associated virus
QGPIWAKIPHTDGNFHPSPLMGGFGLKHPPPQILIKNTPVPADPPTAFNQAKLNSFITQYSTGQVSAEIEWELQKENSKRWNPEIQYTSNYYKSTNVDFAVNTEGVYSEPRPIGTRYLTRNL

SEQ ID NO: 194 - protein, 122 aa, Adeno-associated virus
QGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNSEGTYSEPRPIGTRYLTRNL

SEQ ID NO: 195 - protein, 122 aa, Adeno-associated virus; identical to SEQ ID NO: 186

SEQ ID NO: 196 - protein, 122 aa, Adeno-associated virus
QGPIWAKIPHTDGNFHPSPLMGGFGLKHPPPQILIKSTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 197 - protein, 122 aa, Adeno-associated virus; identical to SEQ ID NO: 194

SEQ ID NO: 198 - protein, 122 aa, Adeno-associated virus; identical to SEQ ID NO: 185

SEQ ID NO: 199 - protein, 122 aa, Adeno-associated virus
QGPIWAKIPHTDGNFHPSPLMGGFGLKHPPPQILIKNTPVPADPPTTFSQAKLASFITQYSTGQVSVEIEWELQKENSKRWNPEIQYTSNYNKSVNVDFTVDTNGVYSEPRPIGTRYLTRNL

SEQ ID NO: 200 - protein, 122 aa, Adeno-associated virus; identical to SEQ ID NO: 185

SEQ ID NO: 201 - protein, 122 aa, Adeno-associated virus; identical to SEQ ID NO: 185

SEQ ID NO: 202 - protein, 122 aa, Adeno-associated virus; identical to SEQ ID NO: 185

SEQ ID NO: 203 - protein, 122 aa, Adeno-associated virus
QGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 204 - protein, 122 aa, Adeno-associated virus; identical to SEQ ID NO: 203

SEQ ID NO: 205 - protein, 122 aa, Adeno-associated virus
QGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVSTEGVYSEPRPIGTRYLTRNL

SEQ ID NO: 206 - protein, 52 aa, Adeno-associated virus
WELKKENSKRWNPEIQYTNNYNDPQFVDFAPDSTGEYRTTRPIGTRYLTRPL

SEQ ID NO: 207 - protein, 738 aa, Adeno-associated virus; identical to SEQ ID NO: 9

SEQ ID NO: 208 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 209 - protein, 738 aa, Adeno-associated virus
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQDEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSARAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNSEGTYSEPRPIGTRYLTRNL

SEQ ID NO: 210 - protein, 6 aa, Artificial Sequence
  source: /note="Description of Artificial Sequence: Synthetic 6xHis tag"
HHHHHH

What is claimed is:

1. A virus comprising a non-naturally occurring, modified AAV VP1 capsid protein, comprising an amino acid sequence having at least 98% sequence identity to the amino acid sequence of an unmodified AAV9 VP1 capsid protein having the sequence shown in SEQ ID NO:12 when the amino acid sequence of the modified AAV VP1 capsid protein and the amino acid sequence of the unmodified AAV9 VP1 capsid protein are aligned;

wherein the amino acid sequence of the modified AAV VP1 capsid protein differs from the amino acid sequence of the unmodified AAV9 VP1 capsid protein at the amino acid position of G267 numbered relative to SEQ ID NO:12 when SEQ ID NO:12 and the amino acid sequence of the modified AAV VP1 capsid protein are aligned.

2. The virus of claim 1, wherein the amino acid sequence of the modified VP1 capsid protein comprises an amino acid modification of G267A compared to AAV9 VP1 capsid protein.

3. The virus of claim 1, wherein the amino acid sequence of the modified VP1 capsid protein is at least 99% identical to the amino acid sequence of the unmodified VP1 capsid protein.

4. A pharmaceutical composition, comprising:
the virus of claim 1, and
a pharmaceutically acceptable carrier.

5. A nucleic acid molecule encoding a non-naturally occurring, modified AAV VP1 capsid protein, comprising
an amino acid sequence having at least 98% sequence identity to the amino acid sequence of an unmodified AAV9 VP1 capsid protein having the sequence shown in SEQ ID NO:12 when the amino acid sequence of the modified AAV VP1 capsid protein and the amino acid sequence of the unmodified AAV9 VP1 capsid protein are aligned;
wherein the amino acid sequence of the modified AAV VP1 capsid protein differs from the amino acid sequence of the unmodified AAV9 VP1 capsid protein at amino acid position of G267 numbered relative to SEQ ID NO:12 when SEQ ID NO:12 and the amino acid sequence of the modified AAV VP1 capsid protein are aligned.

6. A vector comprising the nucleic acid molecule of claim 5.

7. An isolated host cell comprising the nucleic acid molecule of claim 5.

8. A method of altering delivery of an expressible polynucleotide to a target organ of a mammalian subject as compared to delivery of an expressible polynucleotide using a virus having an unmodified AAV9 VP1 capsid protein, the method comprising administering a therapeutically effective dose of the virus of claim 1, thereby altering delivery of the expressible polynucleotide to the target organ.

9. The method of claim 8, wherein the expressible polynucleotide is a transgene.

10. The method of claim 8, wherein the virus comprising a non-naturally occurring, modified AAV VP1 capsid protein exhibits higher transduction of the expressible polynucleotide into cells of the target organ following administration to a first mammalian subject as compared to transduction of the expressible polynucleotide into cells of the target organ following administration of a virus having an unmodified AAV9 VP1 capsid protein to a second corresponding mammalian subject.

11. The method of claim 8, wherein the virus comprising a non-naturally occurring, modified AAV VP1 capsid protein exhibits lower transduction of the expressible polynucleotide into cells of the target organ following administration to a first mammalian subject as compared to transduction of the expressible polynucleotide into cells of the target organ following administration of a virus having an unmodified AAV9 VP1 capsid protein to a second corresponding mammalian subject.

12. The method of claim 8, wherein the virus comprising a non-naturally occurring, modified AAV VP1 capsid protein exhibits higher transduction of the expressible polynucleotide into cells outside of the target organ following administration to a first mammalian subject as compared to transduction of the expressible polynucleotide into cells outside of the target organ following administration of a virus having an unmodified AAV9 VP1 capsid protein to a second corresponding mammalian subject.

13. The method of claim 8, wherein the virus comprising a non-naturally occurring, modified AAV VP1 capsid protein exhibits lower transduction of the expressible polynucleotide into cells outside of the target organ following administration to a first mammalian subject as compared to transduction of the expressible polynucleotide into cells outside of the target organ following administration of a virus having an unmodified AAV9 VP1 capsid protein to a second corresponding mammalian subject.

14. The method of claim 8, wherein the virus comprising a non-naturally occurring, modified AAV VP1 capsid protein exhibits higher expression of the expressible polynucleotide in cells of the target organ following administration to a first mammalian subject as compared to expression of the expressible polynucleotide in cells of the target organ following administration of a virus having an unmodified AAV9 VP1 capsid protein to a second corresponding mammalian subject.

15. The method of claim 8, wherein the virus comprising a non-naturally occurring, modified AAV VP1 capsid protein exhibits lower expression of the expressible polynucleotide in cells of the target organ following administration to a first mammalian subject as compared to expression of the expressible polynucleotide in cells of the target organ following administration of a virus having an unmodified AAV9 VP1 capsid protein to a second corresponding mammalian subject.

16. The method of claim 8, wherein the virus comprising a non-naturally occurring, modified AAV VP1 capsid protein exhibits higher expression of the expressible polynucleotide in cells outside of the target organ following administration to a first mammalian subject as compared to expression of the expressible polynucleotide in cells of the target organ following administration of a virus having an unmodified AAV9 VP1 capsid protein to a second corresponding mammalian subject.

17. The method of claim 8, wherein the virus comprising a non-naturally occurring, modified AAV VP1 capsid protein exhibits lower expression of the expressible polynucleotide in cells outside of the target organ following administration to a first mammalian subject as compared to expression of the expressible polynucleotide in cells of the target organ following administration of a virus having an unmodified AAV9 VP1 capsid protein to a second corresponding mammalian subject.

18. The method of claim 8, wherein the target organ is the liver.

19. The method of claim 8, wherein cells outside the target organ are muscle cells.

20. The method of claim 8, wherein the virus comprising a non-naturally occurring, modified AAV VP1 capsid protein has lower liver toxicity when administered to a mammalian subject than the same dose of a virus having an unmodified AAV9 VP1 capsid protein administered by the same route of administration.

21. The method of claim 8, wherein the mammalian subject is a human subject or a non-human primate.

* * * * *